United States Patent 11,098,302 (IDENTIFICATION OF POLYNUCLEOTIDES ASSOCIATED WITH A SAMPLE) - sequence listing, part 118

SEQ ID NO: 408206 - DNA, 617 bp, Homo sapiens
  misc_feature: GZ8MTXP02IWUSX.38.11.A11.1.454.CMB.2.raw
  modified_base (184)..(184): a, c, t, g, unknown or other
  modified_base (261)..(261): a, c, t, g, unknown or other
  modified_base (358)..(358): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtagganacagagtcaccatcacttggtcgggcgggcacggtattaacacctggttgcctggtatcagcagaaaccagggaacncccctatcgtcctaatcttgatgcatccactttgacaaacgttcggggtccctagtccgtaagttcagccgccccgagtcgatccgtgggaacagtntttcactctaccacctactacgaccaaaccgtgaaacgcctagaacgtattctacgtacttaaatttattaactagtaaccctaaactaaattaacgttaaacttaccgtttaaccccgtacctaacccgttaccggaaccgtaacgggaacctaacgtacgtacggaaacgtaaacttaaaacgtaaacgttcggtacggacttacggacctaacctcgttaacctacgttccttacacttccgttcccgacttaccg

SEQ ID NO: 408207 - DNA, 571 bp, Homo sapiens
  misc_feature: GZ8MTXP02HMIA0.38.11.A11.1.454.CMB.2.raw
  modified_base (267)..(267): a, c, t, g, unknown or other
  modified_base (360)..(360): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcggggcacggtattaacaccgttgggttggcctggtatcagcaagaaaccagggaacncccctatcgtccctaatctttgatgcatcctactttgactaaacgtggggtcccattctaggttcagcgccccgagtggatcgtgggacagtntttcactctcaccatcgacaactgaacgcctagaagattctgtactaatttatactgacctaaactaaataacttaaactaccttacccggtactaccgttccggactaaacgggacacgtacgtaggaactaacgttaaaacgacgtggtaggtactacgaccaacctactcgtcgttaccttctaaccttcccttacccgtacctaacg

SEQ ID NO: 408208 - DNA, 661 bp, Homo sapiens
  misc_feature: GZ8MTXP02G32GX.38.11.A11.1.454.CMB.2.raw
  modified_base (286)..(286): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatctacgttggtcggggcggggactaacgggttaacttaaccgaccgttgggttcggccttgggtatcagacaacgaaaccgagggaaacncccctatcgtaccctaatctttagatgctatcctatttgactaacgtcgggtacctagttcgtaaggttcacggtcgacccgtaggtcgtactcgtaggggactagtctttcactcctacacatcaactacagaacgtctagaacgtattactagtacttaagttactacgtacaaacctaaataaacgttaataaacttaccgttacccgtaccttaacccgttacggaccgaaacgggtaccaacgtacgtacggtaaacgtaaaacgtaaaacgtacgttacggtacgtaaccgttacgacctaaaccgtttactaaccgtttacggttacctttaaccgtacctttaccccggttacccgtacttaaaccg

SEQ ID NO: 408209 - DNA, 642 bp, Homo sapiens
  misc_feature: GZ8MTXP02I0R5S.38.11.A11.1.454.CMB.2.raw
  modified_base (184)..(184): a, c, t, g, unknown or other
  modified_base (225)..(225): a, c, t, g, unknown or other
  modified_base (263)..(263): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtagganacagatcacatcacgttggcggggcgggcacggtattaacnccgtggttcgcctggtatcagcaagaaaccgaggaacnccctatcgtacctaatcttgatgctactcctattcgactaaacgtcgggtaccctagtcgtaggtcacgtccgaccgtagtacgactcggtaggaactagttccttaccactacctaccaactacgtacgaaaccctaaacgtacgaaacgtccgtaaagtaactacttcgtactaactttaatttaactactactaaacctaaacttaaactaacttaaaccgttaacccgttacccgtaacctaaccccgttacggaaccggaaacggtaaccgaacgtaacgtaacggtaaacgtaaaaccgttaaaacgtacgtaggacgtactacgacctactacttcgttacgttccttactaccttcccgtaccgacttacg

SEQ ID NO: 408210 - DNA, 547 bp, Homo sapiens
  misc_feature: GZ8MTXP02HTNAO.38.11.A11.1.454.CMB.2.raw
  modified_base (265)..(265): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacgttggtcgggcgggcaggtacttaacaccgtggtgcctggtatcgagcaagaaaccagggaaacncccctatcgtaccctaatctttgatgcatccactttgactaaacgtgggtccctatcgtagttacacgcgacccagtggatcgtgggacagtctttcactctcacatcgaccactcgaagcctagaacgatttcgtactacttaatttacttactacgaccctaaataattaattaaacctacctttacccggtacctaccgttcgaccaagggacacgactaggaataataacgacgtcgtggactcgcactactcgtctcttactcgtccttccgactac

SEQ ID NO: 408211 - DNA, 610 bp, Homo sapiens
  misc_feature: GZ8MTXP02INPEU.38.11.A11.1.454.CMB.2.raw
  modified_base (270)..(270): a, c, t, g, unknown or other
  modified_base (295)..(295): a, c, t, g, unknown or other
  modified_base (456)..(456): a, c, t, g, unknown or other
  modified_base (579)..(579): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctggtaggagacagatcaccatcacttggtcggggcggggcacggtattaacaccgtggttcggcctggtatcagacaagaaaccgagggaaacncccctatcgtacctaatctttgatncatccactttgacaaacgtcggggtccctagtacgtaggttcaggccgacccgaggtgtactcgtagggacctagtctttacactcctacgacctacgtaccgacaaacccgtgaaacgacctaaggtaactatttctagtaacttaatttattaccgtanaaccctaaataaattaaacgttaaacttacccgttaacggtaccctacgttacccgaacgtaaacgggacaacgtacgtaggaaactaacgttaaaacgagttagacggctacgaccgtaacngtaacttctacttactactccgtaccactac

SEQ ID NO: 408212 - DNA, 512 bp, Homo sapiens
  misc_feature: GZ8MTXP01EIAOK.10.25.C03.1.454.CMB.2.raw
  modified_base (216)..(216): a, c, t, g, unknown or other
  modified_base (256)..(256): a, c, t, g, unknown or other
tcagcatagtagtgcacgaccggtgctcgatttagtagtgtagatttgggtttggggcagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacngccaccctctcctgctgggccagtccgagtgtgcagccgnttagcctggaccagcaaaacctggccagcctcccaggctcctcgtctatggtgcatcccacaagggccactggtatcccagccaggttcagtggcagtgggtctgggacagagttcgctctcacatcagcagtctgcagtctgaagtattttggctagtttattactgtcaggatagtgatggctggcctcgtacttcgttttggccgtaagggaccagttggactaagtacaaacgtactgttcggtcttgaacc

SEQ ID NO: 408213 - DNA, 594 bp, Homo sapiens
  misc_feature: GZ8MTXP01B3CLN.10.25.C03.1.454.CMB.2.raw
  modified_base (217)..(217): a, c, t, g, unknown or other
  modified_base (246)..(246): a, c, t, g, unknown or other
tcagcatagtagtgcacgaccggtgctcgatttagtagtgtagatttgggtttgggggggaggaactgctcagttaggacccagacggaaccatggaagccccagcgcagcttctcttcctcctgctactcaggctcccagaaaccactggagaaatcgtgatgacgcagtctccagcccacctgtctgcgtctccgagggcaaacacgccaccctntcctgctgggccagtccgagtgtgcagcntagctgacagcaaactgcagctccagctctctcatggtgcatccacaacgggccactggtactcccagccaggttcagtggccaggtggtctgggacaagagttcgctcgtcacatccagcagtctgcagtctagaagtagttttgactagtttatacgtagtcaagggggtaattagtgtaacgtgggtcctcggggtacccttaccgtaccgtacgttttacgggaccctaaaggggtaaccctaaagggttgggtaaacttagtaaaccgtaaaacgttaaccgttggttacggggtaacctcggtaacctaacctacgttacccttgggttcccttttaacccg

SEQ ID NO: 408214 - DNA, 523 bp, Homo sapiens
  misc_feature: GZ8MTXP01BKRKK.10.25.C03.1.454.CMB.2.raw
  modified_base (245)..(245): a, c, t, g, unknown or other
  modified_base (428)..(428): a, c, t, g, unknown or other
  modified_base (435)..(435): a, c, t, g, unknown or other
  modified_base (504)..(504): a, c, t, g, unknown or other
tcagcatagtagtgcacgaccggtgctcgatttagtagtgtagatttgggtttgggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttgcagccgnttagcctggtaccagcaaaaacctggccagcctcccaggctcctcgtctatggtgcatccacaaggggccactggtatcccagccaggttcagtggccagtgggtctgggacaagagttcgctctcaccatcagcagtctgcagtctgaagtattttgctagtttattactgtcaggggaatntgatggntggctccgtactcttttggccctaaggggaacctaaggttggaacagtacaaacgaacgttgttacggntgcaccattctgttcttcc

SEQ ID NO: 408215 - DNA, 591 bp, Homo sapiens
  misc_feature: GZ8MTXP01BM689.10.25.C03.1.454.CMB.2.raw
  modified_base (218)..(218): a, c, t, g, unknown or other
tcagcatagtagtgcacgaccggtgctcgatttagtagtgtagatttgggtttggggcagagctctggggaggaactgctcagttaggacccagacggaaccatggaagccccagcgcagcttctcttcctcctgctactcaggctcccagaaaccactggagaaatcgtgatgacgcagtctccagcccaccctgtctgcgtctccagggcaaaacngcccaccctctcctgctgggccagtccgagtgttggcagccgcttagcctggaccagacaaaacctggaccacgccctcccaggcctcctcgtctatggtgcatcccacgaacgggccacgtcggtactcccgacgccgtaggttcgaggtggaccgagggtggggtctggggacaggtacgttcgctcctcgaccatcagcagtctgctagtctagtagttattttgacgttagttttattacgttagtactaaggtaattagtagtagtggtctcggtccttaaccgtacttacgtttcggaccgtaaacgggtacttaaggttgaactaagtaccgtaaacgtaaccgtggttacggtcgttggtaaccc

SEQ ID NO: 408216 - DNA, 769 bp, Homo sapiens
  misc_feature: GZ8MTXP01COY0P.10.25.C03.1.454.CMB.2.raw
  modified_base (249)..(249): a, c, t, g, unknown or other
tcagcatagtagtgcacgaccggtgctcgatttagtagtgtagatttggggtttggggggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacacgccaccctctcctgctgggccagtccgagtgtgcagccgnttagcctgtaccagacaaaactgccagcctcccaggctcctcgtctatggtgcaactccaacgtaaacggggcccaacgttcggtaacttccccgagtaccgtagggtttccgaaggttcgggacccgtaagggttcgggggttcgttagggggaaccgtaaacgggtaacggtttccggccttccgttaccaaccccgtaacttccgaacggcctaacggttccgtcggtacccgtaaggtttccgttaaagggttaaaggtttagttttttacggtaccgtttaaagggttttaactttaacccgttagttaaccgtaaaggggggttaaattaaggtttaggtaagttgggtcccgttacggttaccccgttaccggttaaccgttaccgtttttacgggacccgtaaagggtaaccccgtaaagggttacgggaaacttaacgtaaaccgtaaaacggttaaccgttggttacggtaaccttcggaacctactacgttcttcgttaaccgtttccc

SEQ ID NO: 408217 - DNA, 582 bp, Homo sapiens
  misc_feature: GZ8MTXP01BGDV8.10.25.C03.1.454.CMB.2.raw
  modified_base (220)..(220): a, c, t, g, unknown or other
tcagcatagtagtgcacgaccggtgctcgatttagtagtgtagatttgggtttggggcagagctctggggaggaactgctcagttaggacccagacggaaccatggaagccccagcgcagcttctcttcctcctgctactcaggctcccagaaaccactggagaaatcgtgatgacgcagtctccagcccaccctgtctgcgtctccgagggaccaaacncgcccaccctctcctgcgtgggccagtccgagtgtggcagccgctagcctggaccagacaaaacctggccacgccctccaggcctcctcgtctagtggtgcatcccaacgacgggccacgtggtactccgacgcctaggttcaggtcggacgagggttgggtcgtggggactaggtacgttcgctctcactatcgagctagtctgctagtcagaagttgtttgacgttaagttttatacgtgtacgaggtaatgtgtagtcggtactcgggtccttaaccgtacttacggtttacggaccgtaaagggtaccttaaggttcggaactaattaacgaaacgtcgtggttacgtcgttcgaacc

SEQ ID NO: 408218 - DNA, 582 bp, Homo sapiens
  misc_feature: GZ8MTXP01DOSAS.10.25.C03.1.454.CMB.2.raw
  modified_base (249)..(249): a, c, t, g, unknown or other
  modified_base (408)..(408): a, c, t, g, unknown or other
tcagcatagtagtgcacgaccggtgctcgatttagtagtgtagatttgggtttggggggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgnttagcctggtaccagacaaaacctggccagcctcccaggctcctcgtctatggtgcactccacgaacgggccactggtactcccagccaggttcagtggccaggtggtcgtgggacaagagttcgctctcacatcagcagtctgacagtctagtaagtnttttgacttagtttatactgtacaggggtaattagtgtagtggctcgggcccttaccggtacttacgttttcgggaccgtaaaggggtaacctaaaggttcggaacttaacgtaacgaaacgttaacgttggttacggcttacggcctaacctattcttaacgttcctttaacc

SEQ ID NO: 408219 - DNA, 606 bp, Homo sapiens
  misc_feature: GZ8MTXP01A105H.10.25.C03.1.454.CMB.2.raw
  modified_base (207)..(207): a, c, t, g, unknown or other
  modified_base (249)..(249): a, c, t, g, unknown or other
tcagcatagtagtgcacgaccggtgctcgatttagtagtgtagatttgggtttggggggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacncgccaccctctcctgctgggccagtccgagtgtgcagccgtnttagcctgtaccagacaaaacctgccacgcctcccaggctcctcgtctatggtgcactccacgaacgggccacgtggtactcccgagccgagttcagtcggcaggtgggtcgtgggacaaggtacgttcgctcgtcaccatcagctacgtctgctagtctagaagttatttgacttagtttatacgtagtacaggggtaatagtgtagtcggctcggtcctaccgtcgttacgtttcggaccgtaaagggtaaccctaaggttcggaaacttacgtaaacgtaaaacggttacgttcgggttacggtaactaccggtaacctaacccgtacgttaccttcgttcccgttttaacccg

SEQ ID NO: 408220 - DNA, 613 bp, Homo sapiens
  misc_feature: GZ8MTXP01BSZ1H.10.25.C03.1.454.CMB.2.raw
tcagcatagtagtgcacgaccggtgctcgatttagtagtgtagatttgggtttggggggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacacgccaccctctcctgctgggccagtccgagtgtggcagccgcttagcctggtaccagacaaaacctggccagcctcccaggctcctcgtctatggtgcactccacaaggccactggtactcccagccaggttcagtggcaggtggtctgggacagagttcgctcgtcaccatcagcagtctgctagtctagaagtattttgcttagtttatacgtgtactagggggtaaattagtgtagtgggtacttcggtccttacccgttacgttacgttttcgggaccctaaaggggtaaccctaaaggtttcgggaaaccttagtaaaccgtaaaacggttaaccgttgggttacggtaacgtacggtaaccctaaccggtacttccgttaacggtttcccgtttaacccg

SEQ ID NO: 408221 - DNA, 609 bp, Homo sapiens
  misc_feature: GZ8MTXP01AXY3U.10.25.C03.1.454.CMB.2.raw
  modified_base (428)..(428): a, c, t, g, unknown or other
tcagcatagtagtgcacgaccggtgctcgatttagtagtgtagatttgggtttgggggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagaccaaaacctggccagccctcccgaggcctcctcgtctagtggtcgcactccaacgaacgggccacgtcggtactcccgaacgccgtaggttcaggtcggccgtaggtgggtcgtgggacaagtagttcgctctcaccatcagcagtctgctagtctagtaagtnttttgcttaagttattacgtagtacgaggggtaatagtgagtggtctcggtcctaccgtacttcgtttacggacctaaacgggtaacctaaaggttcggaaaccttaagttaaaccgaaaacggttaacgttgggttacggcttacggaacctaccgtacttccgttaacgtttccttccg

SEQ ID NO: 408222 - DNA, 654 bp, Homo sapiens
  misc_feature: GZ8MTXP01AFLRD.10.25.C03.1.454.CMB.2.raw
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagcccaccctgtctgccgtctccagggcaaacacgcccaccctctcctgctgggccagtccgagtgtgcagcgcttagctggtaccagacaaaacctggccacgcctcccaggcctcctcgtctagtgtgcactccgaacgaacgggccacgtcggtactccccgagccccctaagggtttcaaggtcgggcgtaaagggttggggtcgttggggaacctaggtacggtttccgccttctccaacctagtaccgacgccgaaggttctacggacctaggtaccttaggtaaagttagtttttacggacttaaggtttttaacgtttaccgttaggtaccgtaaagggtaattaagtggtagtccggtcgtcgggtccccttacgttaacgttacggttttcggaaccgttaaagggtaccctaaagggttcggaccttaagtaaccaaagcgtacgtgggctgcgtaacc

SEQ ID NO: 408223 - DNA, 595 bp, Homo sapiens
  misc_feature: GZ8MTXP01EY68I.10.25.C03.1.454.CMB.2.raw
  modified_base (208)..(208): a, c, t, g, unknown or other
  modified_base (247)..(247): a, c, t, g, unknown or other
tcagcatagtagtgcacgaccggtgctcgatttagtagtgtagatttggggtttggggggggaggaactgctcagttaggacccagacggaaccatggaagccccagcgcagcttctcttcctcctgctactcaggctcccagaaaccactggagaaatcgtgatgacgcagtctccagccacctgtctgcgtctccgagggcaaacngcccaccctctcctgctgggccagtccgagtgtgcagcnttagctgacagacaaactgcagcctccagctcgtctctatggtgcactccacgagggcctacgtggtactcccgagcctaggttcaggtcggcgaggtgggtcgtgggacgtaagtacgttcgctcgtacacatcgagccgagtctgctagtctagaattatttgtacttaagtttactacgtgtagtaaggggtaattagtagtagtggcgtcggtaccttccggtaacttcggtttacggacccggtaaagggaacctaaggttcggaaacttagtaaaccgaaaacggttaccgttggttcgtaacgtcgtcctaacccgtgttaccttcgttaacccgtttccg

SEQ ID NO: 408224 - DNA, 575 bp, Homo sapiens
  misc_feature: GZ8MTXP01EX19S.10.25.C03.1.454.CMB.2.raw
  modified_base (250)..(250): a, c, t, g, unknown or other
  modified_base (269)..(269): a, c, t, g, unknown or other
  modified_base (374)..(374): a, c, t, g, unknown or other
  modified_base (379)..(379): a, c, t, g, unknown or other
  modified_base (383)..(383): a, c, t, g, unknown or other
  modified_base (393)..(393): a, c, t, g, unknown or other
  modified_base (397)..(397): a, c, t, g, unknown or other
tcagcatagtagtgcacgaccggtgctcgatttagtagtgtagatttggggtttgggggggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacacgccaccctctcctgctgggccagtccgagtgtgcagccgnttagctgacagacaaaacngcagcctccagctcctcgtctatgtgcatccaacaagggccactggactcccagccagtcagtgccaggtggtctggacaagagttcgctctcacatcagcagtntcganagtntagtaagttntttnattagttatagtgtagaagggtaatagtgtagtcggcgttcggtacccttaccgtacgttacgtttacggaaccggtaaagggaaccgtaaaggttacggaaacttaaacgtaaacgtaaaacggttaacgttggttacggtaacgtacgtaaccacctacttacttcgttcgttaac

SEQ ID NO: 408225 - DNA, 664 bp, Homo sapiens
  misc_feature: GZ8MTXP01C8BO7.10.25.C03.1.454.CMB.2.raw
  modified_base (245)..(245): a, c, t, g, unknown or other
  modified_base (288)..(288): a, c, t, g, unknown or other
  modified_base (375)..(375): a, c, t, g, unknown or other
  modified_base (401)..(401): a, c, t, g, unknown or other
tcagcatagtagtgcacgaccggtgctcgatttagtagtgtagatttgggtttggggggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctggccagtccgagtgtgcagcgnttagcctgacagcaaactgcagctccagctctcgtctatggtncatccacaaggccactggtactcccagccaggttccagtggcccagtgggtcgtggggacaaggtagttcgctcgtccaccatcgancgagtcctggctagtcgtagaaagtnttttagtacttacgtttattcctagttaccgaagggggttaactaagttggtaagttcgggtccgttcggtaccccgtttacccggttacccgttaacgttttttaccggggaaccctaaaacgggggtaaccccgttaaagggtttcggggaaaccttaacgttaaacgtaaaacccggttaaaacccgttgggttaacgggtccgtttaaccgggaacccgtaaacccgttacgttacctttccggttcgtttttaacccg

SEQ ID NO: 408226 - DNA, 495 bp, Homo sapiens
  misc_feature: GZ8MTXP02I7JXY.10.25.C03.1.454.CMB.2.raw
  modified_base (476)..(476): a, c, t, g, unknown or other
tcagcatagtagtgcacgaccggtgctcgatttagtagtgtagatttgggtttggggaggaactgctcagttaggacccagacggaaccatggaagcccagcgcagcttctcttcctcctgctactcaggctcccagaaaccactggagaaatcgtgatgacgcagtctccagccaccctgtctgcgtctccagggcaaacagccacctctcctgctgggccagtccgagtgttggcagccgcttagcctggtaccagcaaaacctggccagcctcccaggctcctcgtctatggtgcatccacaagggccactggtatccagccaggttcagtggccagtgggtctgggacagagttcgctctcaccatcagcagtctgcagtctgaagattttgctagtttatactgtcaggatatgatggctggcctcgtacactttggcctaagggaccaagttggactatcaaacgactgnggctgcaccatctgtcttc

SEQ ID NO: 408227 - DNA, 514 bp, Homo sapiens
  misc_feature: GZ8MTXP02HAGO9.10.25.C03.1.454.CMB.2.raw
  modified_base (205)..(205): a, c, t, g, unknown or other
  modified_base (398)..(398): a, c, t, g, unknown or other
tcagcatagtagtgcacgaccggtgctcgatttagtagtgtagatttgggtttggggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacngccaccctctcctgctgggccagtccgagtgttggcagccgcttagcctggtaccagcaaaacctggccagcctcccaggctcctcgtctatggtgcatccacaagggccactggtatcccagccagttcagtggccagtgggtctggggacaggagttcgctctcaccatcagcagtctgcagtctgaagtntttgctagtttatactgtcaggatatgtatggctggcctcgtactcgtttggacaagggtaccaaggttggactagtacaaaacgtactgtagctgaccactatctacgtctttac

SEQ ID NO: 408228 - DNA, 508 bp, Homo sapiens
  misc_feature: GZ8MTXP02F835A.10.25.C03.1.454.CMB.2.raw
tcagcatagtagtgcacgaccggtgctcgatttagtagtgtagatttgggtttgggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagacaaaacctggccagcctcccaggcctcctcgtctatggtgcatccacaacgggccactggtactcccagccaggttcagtgccagtgggtctgggacagagttcgctctcaccatcagcagtctgcagtctgaagtattttgcttagtttatactgtcaggaatatgatgctggcctcgtactactttggccaagggaccaaggttgacagtacaaacgaactggtagctgcaccatctgtcttac

SEQ ID NO: 408229 - DNA, 610 bp, Homo sapiens
  misc_feature: GZ8MTXP02H7ZW6.10.25.C03.1.454.CMB.2.raw
  modified_base (373)..(373): a, c, t, g, unknown or other
  modified_base (388)..(388): a, c, t, g, unknown or other
  modified_base (403)..(403): a, c, t, g, unknown or other
tcagcatagtagtgcacgaccggtgctcgatttagtagtgtagatttgggtttggggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaacctggccagcctcccaggcctcctcgtctatggtgcatccaacaagggccacgtggtatcccagccaggttcagtggccagtgggtctgggacaggagttcgctcncaccatcagcagtcngcagtctagtaagtnttttgctagtttattactgtactaaggtaattagtagattggggcttcggggtacccttccgtacttaccgttttacgggacccgtaaaagggtaacccgtaaaggtttacggaacctaaagttaaccgaaaaacggtaaccgttacggttacgggaaccgtttacggaccgtaaccctaagtttcccgttagtttccctttaaccg

SEQ ID NO: 408230 - DNA, 512 bp, Homo sapiens
  misc_feature: GZ8MTXP02H94HD.10.25.C03.1.454.CMB.2.raw
  modified_base (246)..(246): a, c, t, g, unknown or other
  modified_base (356)..(356): a, c, t, g, unknown or other
  modified_base (382)..(382): a, c, t, g, unknown or other
  modified_base (389)..(389): a, c, t, g, unknown or other
  modified_base (422)..(422): a, c, t, g, unknown or other
  modified_base (429)..(429): a, c, t, g, unknown or other
  modified_base (491)..(491): a, c, t, g, unknown or other
tcagcatagtagtgcacgaccggtgctcgatttagtagtgtagatttgggtttgggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgnttagcctggtaccagcaaaactggccagcctcccaggctcctcgtctatggtgcatccacaagggccactggtatcccagccaggttcagtggccagtgggtctgggacngagttcgctctcaccatcagcagtcngcagtcngaagtattttgctagtttatactgtcaggaatntgatggntcggccttccgtactacgtttggaccaaggtaccaagttggaactatacaaacgacgttagnggctgacaccatctgttcttc

SEQ ID NO: 408231 - DNA, 519 bp, Homo sapiens
  misc_feature: GZ8MTXP02GX0BI.10.25.C03.1.454.CMB.2.raw
  modified_base (397)..(397): a, c, t, g, unknown or other
tcagcatagtagtgcacgaccggtgctcgatttagtagtgtagatttgggtttggggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaacctggccagcctcccaggctcctcgtctatggtgcatccacaagggccacgtggtactcccagccaggttcagtggccagtggtctgggacagagtcgctctcaccatcagcagtctgcagtctgaagtnttttgctagtttattactgtcaggtatatgatggctggcctcgtactacgtttggaccgtaagggtacctagttcggactagtacaaacgtactgtacggctgacaccatctacgtctttac

SEQ ID NO: 408232 - DNA, 549 bp, Homo sapiens
  misc_feature: GZ8MTXP02FZGXN.10.25.C03.1.454.CMB.2.raw
tcagcatagtagtgcacgaccggtgctcgatttagtagtgtagatttgggtttggggcagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagacaaaacctggccagcctcccaggcctcctcgtctatggtgcatcccaacaacgggcccacgtggtactcccacgccaggttcagtggcaggtgggtctggggacagtagttcgctctcaccatcagcagtctgcagtctagaagttattttgacttagtttattacttgtacaggaatatgtatggactcggccttcgtactacgtttcggaccgtaaacgggacctaaggttcggaactaagtaccgaaaacgtacgtaggtacggctacgacc

SEQ ID NO: 408233 - DNA, 544 bp, Homo sapiens
  misc_feature: GZ8MTXP02HN3O8.10.25.C03.1.454.CMB.2.raw
tcagcatagtagtgcacgaccggtgctcgatttagtagtgtagatttgggtttggggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaacctggccagcctcccaggcctcctcgtctatggtgcatccacaagggccactggtatcccagccaggttcagtggccagtgggtctggggacagagttcgctctcaccatcagcagtctgcagtctgaagtattttgctagtttatactgtcaggaattatgatggctggcctcgtactacgtttggacctaaaggggtaccctaaggttggaactaattacgaaaacgaacgttcgtacggccgttaggactacccgattcctcgttcctttaccg

SEQ ID NO: 408234 - DNA, 578 bp, Homo sapiens
  misc_feature: GZ8MTXP02GPNCM.10.25.C03.1.454.CMB.2.raw
  modified_base (248)..(248): a, c, t, g, unknown or other
  modified_base (401)..(401): a, c, t, g, unknown or other
tcagcatagtagtgcacgaccggtgctcgatttagtagtgtagatttgggtttgggggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgnttagcctggtaccagcaaaactgccagcctcccaggctcctcgtctatggtgcatccaacaacgggccacgtggtactcccagccaggttcaggtggccgagtggtctgggacagagttcgctctcaccatcagcagtctgcagtctgaagtnttttgcttagtttattactagtctaaaggaattagtgtagtggcgttcggtcccttacggtaactaccgttttacgggacccgtaaaacgggtaacctaaaggttcggaaactaaagtaccgaaaacgtaacctggttacggctcggacctaccctaatccttacgttcctttaccg

SEQ ID NO: 408235 - DNA, 506 bp, Homo sapiens
  misc_feature: GZ8MTXP02ILAPG.10.25.C03.1.454.CMB.2.raw
  modified_base (498)..(498): a, c, t, g, unknown or other
  modified_base (502)..(502): a, c, t, g, unknown or other
tcagcatagtagtgcacgaccggtgctcgatttagtagtgtagatttgggtttgggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaacctggccagcctcccaggctcctcgtctatggtgcatccacaagggccactggtatcccagccaggttcagtggccagtgggtctggggacagagttcgctctcaccatcagcagtctgcagtctgaagtattttgctagtttattactgtcaggaatatgatggctggccttcgtactcgtttggcctaaggacctaagttggacatacaaacgactgtaggctgcacctntctntctc

SEQ ID NO: 408236 - DNA, 585 bp, Homo sapiens
  misc_feature: GZ8MTXP02JXR98.10.25.C03.1.454.CMB.2.raw
  modified_base (303)..(303): a, c, t, g, unknown or other
tcagcatagtagtgcacgaccggtgctcgatttagtagtgtagatttgggtttgggggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagacaaaacctggccagcctcccaggctcctcgtctatggtncatccacaacgggccacgtggtactcccagccaggttcaggtggccgtaggtggggtcgtggggacaggagttccgctcgtcaccatcagcagtctgcagtctagaagtgtttgctagtttattacttagtacgtaggtaatatgtagtgtacgtcgggccttacccggttactacgttttcgggaacccgtaaagggtaccctaaaggttggaacctaagtaccgaaaacgtaacgttggtacggtccgtaggacctaccgtactcttcggtacttacccg

SEQ ID NO: 408237 - DNA, 577 bp, Homo sapiens
  misc_feature: GZ8MTXP02GZM51.10.25.C03.1.454.CMB.2.raw
  modified_base (408)..(408): a, c, t, g, unknown or other
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaacctggccagcctcccaggctcctcgtctatggtgcatccacaagggccactggtactcccagccccaggttcagtggcagtgggtctgggacagagttcgctctcacatcagcagtctgcagtctgaagtntttgcttagtttattacgtgttacgaaggtaattagtgtaagtggtctggtcccttacccgttactacgtttttacgggacccgtaaacgggggtaaccctaagggtttcggaactaacgttaaccgaaaaacgtaaccgttaggtacggacttacggacctaaacccg

SEQ ID NO: 408238 - DNA, 583 bp, Homo sapiens
  misc_feature: GZ8MTXP02HLK8R.10.25.C03.1.454.CMB.2.raw
  modified_base (206)..(206): a, c, t, g, unknown or other
  modified_base (248)..(248): a, c, t, g, unknown or other
  modified_base (413)..(413): a, c, t, g, unknown or other
tcagcatagtagtgcacgaccggtgctcgatttagtagtgtagatttgggtttggggggaggaactgctcagttaggacccagacggaaccatggaagccccagcgcagcttctcttcctcctgctactcaggctcccagaaaccactggagaaatcgtgatgacgcagtctccagccaccctgtctgcgtctccgagggcaaacngcccacctctcctgctgggccagtccgagtgtggcagccgtnttagcctggtaccagacaaaacctgaccagccctcccaggcctcctcgtctagtggtcgctactccaacgaacggccacgtggtactcccagcctaggttcagtcggcgaggtgggtctgggacagagtcgctctcaccatcagcagtctgcagtctagaagttnttttgacttagtttattactgtacaggtaattagtgtagtcggcgtacgggtcccttaccgtacttacgtttcggaccgtaaagggtacctaaggttcggaactaaagtaaccgaaaacgtaacgtggtacggtcgtcggacctaccgtattccgtacgttcctttaccg

SEQ ID NO: 408239 - DNA, 532 bp, Homo sapiens
  misc_feature: GZ8MTXP02GK08D.10.25.C03.1.454.CMB.2.raw
tcagcatagtagtgcacgaccggtgctcgatttagtagtgtagatttgggtttgggggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaacctggccagcctcccaggctcctcgtctatggtgcatccacaaggccactggtatcccagccgaggttcagtggccaggtgggtctgggacagagttcgctctcaccatcagcagtctgcagtctgaagtattttgcttagtttattactgtacaggtaatatgagttgacttgggcctcgtactcgttttcggacctaagggtacctaaggttggaactagtacaaaacgtacctgcggcttcgacacctatcctagtcttac

SEQ ID NO: 408240 - DNA, 530 bp, Homo sapiens
  misc_feature: GZ8MTXP02F657O.10.25.C03.1.454.CMB.2.raw
tcagcatagtagtgcacgaccggtgctcgatttagtagtgtagatttgggtttgggggggaggaactgctcagttaggacccagacggaaccatggaagccccagcgcagcttctcttcctcctgctactcaggctcccagaaaccactggagaaatcgtgatgacgcagtctccagccaccctgtctgcgtctcctgggcaaacagccaccctctcctgctgggccagtccgagtgttggcagccgcttagcctggtaccagcaaaacctggccagcctcccaggctcctcgtctatggtgcatccacaagggccactggtactcccagccagttcagtggcagtgggtctgggacagagttcgctctcaccatcagcagtctgcagtctgagattttgctagtttattactgtcaggtatatgagtggctggcctccgtactacgtttagggacctaaggggtacctaaggttcggactaagtacgaaacgtaacgtgtacggctcgcctaactgttctcgtcttacg

SEQ ID NO: 408241 - DNA, 578 bp, Homo sapiens
  misc_feature: GZ8MTXP02HI5RM.10.25.C03.1.454.CMB.2.raw
  modified_base (206)..(206): a, c, t, g, unknown or other
  modified_base (247)..(247): a, c, t, g, unknown or other
tcagcatagtagtgcacgaccggtgctcgatttagtagtgtagatttgggtttgggggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacngccaccctctcctgctgggccagtccgagtgtggcagccgnttagcctggtacagcaaaactggccagcctcccaggcctcctcgtctatggtgcatccacaaggccacgtggtactcccagccaggttcaggtggccgaggtggtctggggacaggtagttcgctctcaccatcagcagtctgcagtctagaagttattttgacctttagtttacttacgttagtacgtaaaggtaattagtgtagtggtcgtcggtacccttcgtaacttcgtttacggaccgtaaagggtacctaaggttgaactacgtaacgtaaaacgtacgttggtacgtaacgttcggacctactactcgttcgttacctttacc

SEQ ID NO: 408242 - DNA, 527 bp, Homo sapiens
  misc_feature: GZ8MTXP02I8GRQ.10.25.C03.1.454.CMB.2.raw
  modified_base (248)..(248): a, c, t, g, unknown or other
  modified_base (401)..(401): a, c, t, g, unknown or other
tcagcatagtagtgcacgaccggtgctcgatttagtagtgtagatttgggtttgggggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgnttagcctggtaccagcaaaaacctggccagccctcccaggctcctcgtctatggtgcatccacaagggccactggtactcccagcccaggttcagtggccagtgggtctgggacagagttcgctctcaccatcagcagtctgcagtctgaatntttgctagtttattacttgtctaggtaatatgagtgctggaccttcggtactcgtttagaccgtaagggtaccaggttggactatacaaacgactggtaggctgacctaccatcgtacgtctttac

SEQ ID NO: 408243 - DNA, 553 bp, Homo sapiens
  misc_feature: GZ8MTXP02JN10C.10.25.C03.1.454.CMB.2.raw
tcagcatagtagtgcacgaccggtgctcgatttagtagtgtagatttgggtttggggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaacctggccagcctcccaggctcctcgtctatggtgcatccacaaggccactggtactcccagccagttcagtggccagtggtctgggacagagttcgctctcaccatcagcagtctgcagtctgaagtatttgcttagttattactgtcaggtatagtgtatggctggcctccggtactacgttttcggaccgtaaggggtaccctaaggttcgggaactacgtacgtaaaacgtaaaccgtggttacggcgttacggtaccaaccctattccgtacgttctttacc

SEQ ID NO: 408244 - DNA, 532 bp, Homo sapiens
  misc_feature: GZ8MTXP02FIM3Y.10.25.C03.1.454.CMB.2.raw
tcagcatagtagtgcacgaccggtgctcgatttagtagtgtagatttgggtttggggagagctctggggaggaactgctcagttaggacccagacggaaccatggaagcccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagacaaaacctggccagccctcccaggctcctcgtctatggtgcatccacaagggccactggtatcccagccccaggttcagtggcagtgggtctggggacaggagttcgctctcaccatcagcagtctgcagtctgaagtatttgctagtttattactgtacaggtaatatgatggctggccctccgtactacgttttggcctaaagggacctaagttacggactagtaaccgaaaacgtaactggtagctcgactaacc

SEQ ID NO: 408245 - DNA, 730 bp, Homo sapiens
  misc_feature: GZ8MTXP02JCBOP.10.25.C03.1.454.CMB.2.raw
  modified_base (209)..(209): a, c, t, g, unknown or other
  modified_base (252)..(252): a, c, t, g, unknown or other
tcagcatagtagtgcacgaccggtgctcgatttagtagtgtagatttggggtttggggggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggacaaacngcccaccctctcctgctgggccagtccgagtgttggcagccgnttagcctgtaccagacaaaactggccagcctccgaggcctcctcgtctagtggtgctactccaacgacggcctacgtcggtactcccagtcccgtaggttccaggtcggccgtagggttcggggtcgtaggggactaggtacgtttccggcttccgtaccaaccctacttacgaacgctaacgttccgtacggacgtaggttaccgtaaggtaaagtttacgtttttaggaccgtttaaggttttaaacgtttacgttacggttaaacgtaagggtaaatttagtaggttaaggttccggtacgttccgggttacccttacccggttaaacgtttacggtttttaccgggaaaccggttaaaacggggtaacccgttaaaggttacgggtaaactaaacggttaaaccgaaacgtaaaccggtttggacgggtaacttacggacctaactacgtttacgtacggtttacctttaaccg

SEQ ID NO: 408246 - DNA, 600 bp, Homo sapiens
  misc_feature: GZ8MTXP02HCQV2.10.25.C03.1.454.CMB.2.raw
  modified_base (207)..(207): a, c, t, g, unknown or other
  modified_base (242)..(242): a, c, t, g, unknown or other
  modified_base (245)..(245): a, c, t, g, unknown or other
  modified_base (262)..(262): a, c, t, g, unknown or other
  modified_base (266)..(266): a, c, t, g, unknown or other
  modified_base (269)..(269): a, c, t, g, unknown or other
  modified_base (272)..(272): a, c, t, g, unknown or other
  modified_base (277)..(277): a, c, t, g, unknown or other
  modified_base (284)..(284): a, c, t, g, unknown or other
  modified_base (286)..(287): a, c, t, g, unknown or other
  modified_base (301)..(301): a, c, t, g, unknown or other
  modified_base (306)..(306): a, c, t, g, unknown or other
  modified_base (327)..(327): a, c, t, g, unknown or other
  modified_base (349)..(349): a, c, t, g, unknown or other
  modified_base (361)..(361): a, c, t, g, unknown or other
  modified_base (430)..(430): a, c, t, g, unknown or other
tcagcatagtagtgcacgaccggtgctcgatttagtagtgtagatttgggtttgggggggaggaactgctcagttaggacccagacggaaccatggaagccccagcgcagcttctcttcctcctgctactcaggctcccagaaaccactggagaaatcgtgatgacgcagtctccagccaccctgtctgcgtctccgagggcaaacncgccaccctctcctgctgggccagtcgagtgtgcngcntagctgtacagcaaacngcanccnccngctcntcatgtncnncagacggcagtgcnccganccagtcaggtgcgagtggtcngggacaggagttcgctctcacntcgagcagttcncgcacgttctagtaagttacgttttgactttaacggtttattacgtttaggtacgtaaaggtaattagnggttaagtcggtaccgttcggtcccgttaccgttacgttacggtttacggaaccgtaaacggggtaaccttaacgggttacggaacttaaacgtaacccgtaaaacggtaaccgttcggtaacggcttacggaacctacccgtagttcccgttacgtttcctttaacccg

SEQ ID NO: 408247 - DNA, 574 bp, Homo sapiens
  misc_feature: GZ8MTXP02FKC1Y.10.25.C03.1.454.CMB.2.raw
tcagcatagtagtgcacgaccggtgctcgatttagtagtgtagatttgggtttggggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaacctggccagcctcccaggctcctcgtctatggtgcatccacaagggccactggtatcccagccaggtcagtgccagtggctgggacagagttcgctctcgaccatcagcagtctgcagtctgaacgtattttgctagtttacttacgtgtcaaggtaattagtgaagtggacctgggcccttccggtaactcttttacgggccgaaacggggtaaccctaagggtttaggaactaattacgaaaaaccggtacttacggttacggaacgtacggtacccgacctaattccttcggttactttaaccc

SEQ ID NO: 408248 - DNA, 540 bp, Homo sapiens
  misc_feature: GZ8MTXP02HI3DU.10.25.C03.1.454.CMB.2.raw
  modified_base (217)..(217): a, c, t, g, unknown or other
  modified_base (253)..(253): a, c, t, g, unknown or other
  modified_base (274)..(274): a, c, t, g, unknown or other
  modified_base (302)..(302): a, c, t, g, unknown or other
  modified_base (390)..(390): a, c, t, g, unknown or other
  modified_base (411)..(411): a, c, t, g, unknown or other
  modified_base (523)..(523): a, c, t, g, unknown or other
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtcctccagcccaccctgtctgcgtctccagggcaaacngccaccctctcctgctgggccagtccgagtgtggcngcgctgctgaccagacaaacngccacgcctccagctcctcgtctgtgtncatccacgaaggccacgtgtactcccgagccccgtaggttcagtggcgtaggtcgggtcgtgggacaggtagttccgctctcacatcngctagtctgcagtctagagtnttttgacgttagtttacttagtagtacgtaaggtaatagtgtagttggcgttcgaccttcgtacgtacgtttgaccgtaaggacctaagtcgaacacgtaacgaacgtacgngtacggctacgactacg

SEQ ID NO: 408249 - DNA, 572 bp, Homo sapiens
  misc_feature: GZ8MTXP02JB0M4.10.25.C03.1.454.CMB.2.raw
  modified_base (208)..(208): a, c, t, g, unknown or other
  modified_base (445)..(445): a, c, t, g, unknown or other
tcagcatagtagtgcacgaccggtgctcgatttagtagtgtagatttgggtttggggggggaggaactgctcagttaggacccagacggaaccatggaagccccagcgcagcttctcttcctcctgctactcaggctcccagaaaccactggagaaatcgtgatgacgcagtctccagcccaccctgtctgcgtctccagggcaaacncgcccaccctctcctgctgggccagtccgagtgttggcagccgcttagccgtgtaccagaccaaaactggccacgcctccaggcctcctcgtctatggtgcatcccaacgaacgggccacgtcggtactcccagccaggttcacggtggccgtaggtcgggtcgtacggggacaggtacggttcggcttccgtactacccgacttacgacgctacgtctgctagtctaggtaagttntttagacttagtttattactgtacaggtaatgtagtagtggcgtggcccttcgtacttacgtttacggacgtaaggtactaggtcgaactactacgaaacgtactgtgctgacacgatctcgtactc

SEQ ID NO: 408250 - DNA, 497 bp, Homo sapiens
  misc_feature: GZ8MTXP01B8FT7.52.12.B01.1.454.CMB.2.raw
  modified_base (438)..(438): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccacctcagtgtccgtgtccccaggacagacagccagcatcacctgctctggagataaattgggggataaatatgtttcctggtatcagcagaagccaggccagtcccctgcgttggtcatctatcaagataccaagaggcgctcagggatccctgacgcgattctctggctccaactctggggacacagccactctgaccatcagcgggacccagactctggactgaggctggactattactgtcaggcgtgggacagcagcacgggggtnttcgggcggagggcccaagctgaccgttcaggtcagccaaggcttcgccccttggtccc

SEQ ID NO: 408251 - DNA, 576 bp, Homo sapiens
  misc_feature: GZ8MTXP01BR8D0.52.12.B01.1.454.CMB.2.raw
  modified_base (308)..(308): a, c, t, g, unknown or other
  modified_base (337)..(337): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagcaggcatagctagttattagcctggtatcgaagacaaaaccgagggaaacncccctaaagctcctagactctagtggtcncagtctaactttgaacgtaagggtcgggtacccaagtacgaaggttcaggtcggacagtggaattcggagggaactagtaattcaactctacactaatcaacgcacgcctgaccagccgtagaagttatttcgacttaattacttatcgtaacttaaacctactttaagtacgtttaccttccttcttaccgtttccggcccgtaagggtaacctaaggttcgaacttaacgtaaaccg

SEQ ID NO: 408252 - DNA, 552 bp, Homo sapiens
  misc_feature: GZ8MTXP01DAJXV.52.12.B01.1.454.CMB.2.raw
  modified_base (136)..(136): a, c, t, g, unknown or other
  modified_base (317)..(317): a, c, t, g, unknown or other
  modified_base (429)..(429): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgntcagctcctggggctcctgctgctctggctcccaggtgccagatgtgacatccagttgacccagtctccatccttcctgtctgcatctgtaggagacagagtcaccatcacttgcccgggccagtcagggcagttagctagtttatttagcctggtatcaagacaaaaaccgagggaaacncccctaaagcctacctagatctagtggtcgacatacaactttgaacgaagggtcgggtacccagtacgaaggttcagggcgcagtggatcgtagggacagaattcactctanacaatcaagcagtccagcacgccgtagaagttatttcgactaacttattacctgtaacaactaacttaagtacttaccttcttcttacgtttccgcccgtggaaccaagttgaacaagtaacc

SEQ ID NO: 408253 - DNA, 521 bp, Homo sapiens
  misc_feature: GZ8MTXP01AJBCS.52.12.B01.1.454.CMB.2.raw
  modified_base (336)..(336): a, c, t, g, unknown or other
  modified_base (438)..(438): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggccagtcagggcattagcagttattagcctggtatcagacaaaaaccgagggaaacgcccctaaagctcctgatctatggtcnctatcaactttgaccgaagggtcggggtcccagtcgaaggttcaggcgcagtgatcgtgggacagaattcatcacacaatcagcagcctgcagcctgaagtntttgactacttatctgtacaaactaccttaatacgttccttcttcacgtttccgcctgggaaccaaggttcgaacaataaccg

SEQ ID NO: 408254 - DNA, 685 bp, Homo sapiens
  misc_feature: GZ8MTXP01ENXZG.52.12.B01.1.454.CMB.2.raw
  modified_base (305)..(305): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagcaggcattagcagttattagctggtatcagacaaaaaccgaggaaacncccctaaagctcctgatctaagtggtacactatactaacgttgaacgtaagggtcgggtaccctaagtacgtaacggttcgacgggcggtacgtaggtggtagtacggtagggaaactaagttaaacttacctaactactacaaactaacgtacgacgaccgacgtccgtacgacgaacgtaccgtaaggtaaacgtttaatttacgtaaccttaaactttacgttaactaacgttaaaccttaaaaccttaaaccgttttaaacgttaaaccgtttaaccctttacccgtttaccgttacccggttttaacccgggtacccgttaaaccggggtaaaacccgtaaaacgggttaccggtaaaccgttaaacgtaaaccg

SEQ ID NO: 408255 - DNA, 518 bp, Homo sapiens
  misc_feature: GZ8MTXP01EHTTK.52.12.B01.1.454.CMB.2.raw
  modified_base (503)..(503): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataaagttgggggataaatatgttcctggtatcagcagaagccaggccagtcccctgcgttggtcatctatcaagataccaagagcgctgagggactccctgacgcgattctctggcctccaacgtcgtggggacacacgcccaactctgaccatcacgccggacccagactctggatgaggctgacgttattacgtgtcaggccgtgggacagcgaggcgacgggggtgtcgggcggagggaccaaggctggacccgttcgttaggcacgcccgaaggccncgccccgttcggtcc

SEQ ID NO: 408256 - DNA, 570 bp, Homo sapiens
  misc_feature: GZ8MTXP01ENLMK.52.12.B01.1.454.CMB.2.raw
  modified_base (307)..(307): a, c, t, g, unknown or other
  modified_base (325)..(325): a, c, t, g, unknown or other
  modified_base (331)..(331): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatcctcctgtctgcatctgtaggagacagagtcaccatcacttgccgggcagcagggcattagctagttatttagcctggtatcagacaaaccagggaaacnccccaagctcctgatctntggtcncatcaactttgacaagggtcgggtacccatcgaaggtcaggcgcagtgggatcgtgggacagaaattcactctcacaatcagcgcgctcgcacgcgtagtaagtattacgtactaacttacttactaactaacttaaacctaaaccttaacgttaacgtttaacttaccgtttccttaccgtttaacccggtacccgtaaccgggtaaccgtaaacggttacgtaacgttaacgtaacg

SEQ ID NO: 408257 - DNA, 790 bp, Homo sapiens
  misc_feature: GZ8MTXP01EI42P.52.12.B01.1.454.CMB.2.raw
  modified_base (314)..(314): a, c, t, g, unknown or other
  modified_base (344)..(344): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttcctgtctgcatctgtagagacagagtcaccatcacttgccggccagcagggctattagctagttattagcctggtatcaagaaccaaaaaaccgagggaaacncccctaaagcctacctagatctagtggtcnctatactaaacgtttgaacgtaaagggttcggggtaccctaagtaccgtaaagggtttcaagggtcccggtacgtagggttagggtaaatttccgggtaagggggaaaccctaaagggtttaaaaacctttcccgtaaaccctttcccgttaaccgaaaacctaaaacggttccaaaccgggtaccgaaacgggtcccctttagggacccttaaaccgggacccctttaaggggtaaagttttaactttttaccggaaacctttaaaacccgtttttaattaacccgtttaacgttaaaccccttaaaaaccgttaaaccccgtttttaaaagggtaacccgttttaaccctttaccccgggtttaccttaaacccgtttttcccggggaacccctttaagggggaaaaccctaaaggttacgggtaacccttaaaacgtaaaccg

SEQ ID NO: 408258 - DNA, 524 bp, Homo sapiens
  misc_feature: GZ8MTXP01APRDZ.52.12.B01.1.454.CMB.2.raw
  modified_base (505)..(505): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataaagtgggggataaatatgttctggtatcagcagagccaggccagtcccctgcgttggtcatctatcaagataccaagagcgctcagggatccctgacgcgatctctggacctccaactcgtcggggaccacacgccacttcacgaccatcgacggccgggacccagactcgtggatgagctagactattacgtgtcgagggccgtggacaggcaggcgtacgggggtgtcgggacgggacgggaccagtcgtcgacccgttcgaggtcacgcccgaaggcnccgtccccgttggtaaccc

SEQ ID NO: 408259 - DNA, 686 bp, Homo sapiens
  misc_feature: GZ8MTXP01D8XOX.52.12.B01.1.454.CMB.2.raw
  modified_base (260)..(260): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataaagtgggggataaatatgttctggtatcagcagaanccaggccagtcccctgcgttggcatctatcaagataccaagaggcgctcagggctcccgtgacgcgtattctcgtcggacctaccaacgtcgtacggggaccacgacgccactctacgaccatcgacggccgggacccagacttcgtggatcgacgggtctacggtaacgtttaactttaaccggtgttaccggaggggtcccgttagggggacgaaacggccggtaacgggtcccgggtaaccgggggggggtttgggttcccgggggaaccgggggaacgggggaaaccccgttaaacgggccggtttaacccgggaaccccgggtttcccggtttaaacgggggtaacccgaacccgggtcccccgggtaaacggggccccgttaccccggggtccccccccggttaacggggtttccccccg

SEQ ID NO: 408260 - DNA, 643 bp, Homo sapiens
  misc_feature: GZ8MTXP01COYFC.52.12.B01.1.454.CMB.2.raw
  modified_base (232)..(232): a, c, t, g, unknown or other
  modified_base (314)..(314): a, c, t, g, unknown or other
  modified_base (458)..(458): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttcgacccagtctccatccttcctgtctgcatctgtagganacagagtcaccatcacgttcgccgggcagcagggcattagctagttattagcctaggtatacaagaacaaaaccgaggaacncccctaagctactgatctagtggtcactatctaacgtttgaacgtaacgggtcgggtaccctaagtaccgtaaaggttcaacgggtcggactagggttggaatcggtaggggaactaaggtaacttaccactacacaactaacncacgacgacgtcctagacgacgtacgtagtaattactttactaacttaactttacttaaccgtaacgtaaaccttaaaccttaaactttaaacgtttaaccgtttacccttacccgtttccgttacccgtttaacccggaacccgttaacggaaaccgtaaggttacgtaaccttaacgtaaccg

SEQ ID NO: 408261 - DNA, 615 bp, Homo sapiens
  misc_feature: GZ8MTXP01DJ48M.52.12.B01.1.454.CMB.2.raw
  modified_base (231)..(231): a, c, t, g, unknown or other
  modified_base (312)..(312): a, c, t, g, unknown or other
  modified_base (337)..(337): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccgggcagcagggcattagcagttatttagcctaggtatcaagaccaaaaaacagggaaacncccctaagctcctgatctatggtcncatcaactttgacgtaaggtcgggcccatcgaaggtcagcggcagtgatcgtagggacagtaattcacttcacaacaaactcaagcaacggtccctagaccgtaggccctagtaaacggttaatttttcggaaaccttaaactttaactttacgtaacgttaaccttaaaaccttaacccgtttaaatttaacgtttaccctttaccgtttcttaaccgttttcccgggaccccgttaaggggaaaccctaaaggttccggaacttaacttaaacccg

SEQ ID NO: 408262 - DNA, 571 bp, Homo sapiens
  misc_feature: GZ8MTXP01EUOLY.52.12.B01.1.454.CMB.2.raw
  modified_base (220)..(220): a, c, t, g, unknown or other
  modified_base (278)..(278): a, c, t, g, unknown or other
  modified_base (438)..(438): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctganataagtggggataatatgttctggtatcagcagaagccagccacgtccctgcgttgtnatctatcaagataccaagagcgctcgagggactccctgacgcgtattcgtctggtacctccctaacgtcgtaggggaccacgacgcccactctcgacatcgacggaccggaccagactcgtggatagacgtctagaccttagttcgtgtccgaggtccgnggacagcgtacggacggtacgggggttggttaacgggcgggacggggaccgaacggtccgtcggttaccccgttccgttaacgggccaacggccccgaacgggtccgttcccggtcccccgttgggttccccg

SEQ ID NO: 408263 - DNA, 669 bp, Homo sapiens
  misc_feature: GZ8MTXP01COFS2.52.12.B01.1.454.CMB.2.raw
  modified_base (136)..(136): a, c, t, g, unknown or other
  modified_base (313)..(313): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgntcagctcctggggctcctgctgctctggctcccaggtgccagatgtgacatccagttgacccagtctccatccttcctgtctgcatctgtaggagacagagtcaccatcacttgccgggccagtccagggcattacgctagttattagcctggtatcagacaaaaacgagggaaacncccctaaagcctaccgtagaacttctaagtggtcgactaacttcgtaaacgttttggaaccgtaaacggggttcgggggtacccctaagtaccgaaacggggtttccaaggggccggactagggttgaacgttcggaggggaaccaaggtaaatttccaactctacaacaaggttacaaggtcaacggtcctacgacacgtaccgtacgtaacggtaacgtttagttactaactttaaactttaacgttaacttaaccttaaacttaaaccttaaacgttaaacttacttaccgttccttaccttaaccggtacccgtaacggtaccgtaacgttacggtaacgttaactaaaccg

SEQ ID NO: 408264 - DNA, 531 bp, Homo sapiens
  misc_feature: GZ8MTXP01DDMS2.52.12.B01.1.454.CMB.2.raw
  modified_base (220)..(220): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcactgctctgganataaagttgggggataaatattgttcctggtatcagcagaagccaggccagtccccctgcgttggtcatctatacaagataaccgaagaggcgcgtcgagggactccctgacgcgattctctggcctaccaactcgtaggggaccacacgccactcagaccatcgacgccgggacccagacctgtaggatgagctagacgttattacgtgtcgaggcgtgggacaagcagcggacgggggtgtggggcgaggggaccaaggctggaccgttcgacggtcaacgcccaaggccgttcgtccccgttggtccc

SEQ ID NO: 408265 - DNA, 517 bp, Homo sapiens
  misc_feature: GZ8MTXP01C6ADL.52.12.B01.1.454.CMB.2.raw
  modified_base (307)..(307): a, c, t, g, unknown or other
  modified_base (332)..(332): a, c, t, g, unknown or other
  modified_base (403)..(403): a, c, t, g, unknown or other
  modified_base (444)..(444): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagcagggcattagctagttattagcctggtatcagacaaaaacagggaaacncccctaagctcctgatctatggtcncatcaactttgaacgaagggtcgggtacccatcaaggtcaggcggcagtgatcgtgggacagattcactcncacatcagcagcctagcagcctagagtatttgactaacttnttactgtacaaactaccttaattacgttacttccttcttactttcgcctgggaccaaggttcgaacaagtaac

SEQ ID NO: 408266 - DNA, 704 bp, Homo sapiens
  misc_feature: GZ8MTXP01AWOC8.52.12.B01.1.454.CMB.2.raw
  modified_base (232)..(232): a, c, t, g, unknown or other
  modified_base (314)..(314): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttcgacccagtcctccatccttcctgtctgcatctgtaganacagatcacatcactcggccggcagtcgaggctatagctagttattagcctaggtatacaagaaccaaaaacgaggaaaccncccctaaagtcctaccgtagacttcgtagtcggtacactatacgtaacgttgaacgtaagggtcgggtaccctagtacgtaacggttcgaacggcgacaggtggtatcggagggaacaagtaacttcactctacaactaaatcgacgacgtacgtaccgttacgaccgtacgtacccgttaaggtaacgtttaactttacggtaaaccctttaaactttaccttaccggttaacgttaacccttaaaacctttaaacccttttaaacggtttaaacccgtttaccctttacccgtttaccgtttaccccggtttaaccccgggaaccccggtttaacggggaaacccttaaacgggggttaccgtaaaccgttaacgttaaaaccccggg

SEQ ID NO: 408267 - DNA, 618 bp, Homo sapiens
  misc_feature: GZ8MTXP01A3QFL.52.12.B01.1.454.CMB.2.raw
  modified_base (222)..(222): a, c, t, g, unknown or other
  modified_base (251)..(251): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtcgtccccaggacagacagccagcatcacctgctctgganataaagtggggataatatgttctggtatnagcagaagccaggccacgtcccctgtcgttggtcatctatcaagactaccaagacggcgctacgagggactcccgtgacgcgtattctctcggacctcccaacgtccgtagggggaaccaccgaacgccctaacttcgaccgaaccatccgaacggcccgggaccctaagtaccttcgagggaactggaacggtcgttacggtatttaacgttccggttagtccggaagggtccggtaggggaccaaggcccgtaggggaccggtgggggtcggttcggggacgggacggggacccaaaggccgtacggaacccggttcacggggtccaccgcccggaaggtcccgttccgccccccgtttggcccc

SEQ ID NO: 408268 - DNA, 607 bp, Homo sapiens
  misc_feature: GZ8MTXP01ASECZ.52.12.B01.1.454.CMB.2.raw
  modified_base (260)..(260): a, c, t, g, unknown or other
  modified_base (392)..(392): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataaagttgggggaataaatattagttcctggtatcagnagaagccaggccagtcccctgcgttggtcatctatcaagataccgaagacgcgctacgacgggactcccgtagaccgcggtacttcgtacgtcggtacctccgtaactcgtacggggacacgacgccactcncgacactcgacggcgacccagaccttcgaggactacgacgggtactacggtacttaaacgttcgtacgtaccgagggcggttacggacgacggcgaacggtccggtaacgggggttgggtcccggaagggaggacccgttaagcgggtacgaacccggttcgttaacggtccgacggaaccccgaggggtcccttaccgttccccggaaggtccc

SEQ ID NO: 408269 - DNA, 636 bp, Homo sapiens
  misc_feature: GZ8MTXP01C37AB.52.12.B01.1.454.CMB.2.raw
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcacgccaccctcagtgtccgtcgtccccaggacagacagccagcactcacctgctcgtaggagaagtaaagttagggggaattaaatattcgtttcctggtatcgagcagaagccacggccacgtcccctgcgttggtcatctatacaaagtataaccgaagacggcgactacgacgggactcccgtgaaccgcgtacttcgtacgtcggtacctaccctaacgtcgtacggggacacgacgacctaacgtcacgaacctataccgacggacccggtaacccaagtacctgttagggaatggaggtactaggtaaccgttattacgtcgtacgagggccgtaggacgagccgaaggtcgggacggggttcggtaacggggcggacgggacaaggttcgcggttaacccgttcgaacggtccgacccggaacccggaacggcccgttcccggtcccccgtttaaccggtccccg

SEQ ID NO: 408270 - DNA, 935 bp, Homo sapiens
  misc_feature: GZ8MTXP01BBFMD.52.12.B01.1.454.CMB.2.raw
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtcgtccccaggacagacagccagcatcacctgctcgtggaagtaagtaaagttaggggggtaattaaaagttagtttcggttttacccgttagggttaacttaccgaaggacgaaacggaaacggaccccgaacgggaccccgaaccggttccccccgttggtccggtttcgggtacctacgttaccttaacgttaaccgaaacgtaaacgttaaacccgaaaggtacgggaccggtccgtacggaacgggggtaccttccccgtacggtaaccgtaccggtaacgtttcccgttcccgttacggggtaccccttaacccgtaaccgttccgggtaaccgggggaaaccctaacccgaccgggtacccctaacgttacccgttaccgaaacccgtacgttaccggaaccggggaccccggggaaacccctaaccgggtaccccgtttagggtaccgggtaaggttacgggaaaccgggttcgtaaccggttaaccttaacgttttaaccgtcgggtaccggtacgggttaccgggggtacggaaccgaacggggaccggacgggtacccgggggttaacgggggggttcggttaaccgggggaccgggggaaacgggggaaaccccgttaacgggacccggttacccgggttaaaccccggttccggttaacccggggtaaccgaacccgggccccggtaaacccggggtccccgttaccccccggggtcccccgtttcccggggttcccccg

SEQ ID NO: 408271 - DNA, 598 bp, Homo sapiens
  misc_feature: GZ8MTXP01B1I3M.52.12.B01.1.454.CMB.2.raw
  modified_base (231)..(231): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccgggccagcagggcatagctagttattagctggtatcagacaaaacgaggaacacccctaagcctctagatctagtggtcacatctaaactttgaacgtaacgggtcggggtaccctagtacgtaacggttacgaacgggtcggactagggtggtagtaccggtaggggaacaacggtaaacttcctaaccttccacaacaatcaacgacgacggtcctcgaccgtacgcctaggaacgttagtttacgacttaacttacttacgtaactacttaaacctacttaaagttacgttaccttcttcttacgttccgccgtaacgactaagttcgtaacaacgtaaaccg

SEQ ID NO: 408272 - DNA, 744 bp, Homo sapiens
  misc_feature: GZ8MTXP01DVHLM.52.12.B01.1.454.CMB.2.raw
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtcgtccccaggacagacagccagcatcacctgctctggagaagtaaagttagggggaattaaatattgttcctaggtatcagcagaagccaggccagtcccctgcgttgtcatctatacaagactaaccgaaggaggcgacgtcgagggactcccgtggacgcggtattcgtcgtcggtaccctaccgtaacgtcgtacgggggaaccaaccgacgtacccacctccgttacgaaccctacgtccgaaaccgggcccgggaaacccccgtaaggtaacccgtttcggtcggggtaaccaggggtacgtaccgttacgggttaaccttttaagtttaccgttacgggttacccgagggggtacccggttaaggggaccgtaaacgggtcggaacgggtacccggggtaacggggggggtttccgtaaccgggggaccggggaacggggaaacccgttaaacgggtccgtacccgggttaacccggttccggttaaacgggtcccgaaccggaaccccggttacgggcccttccccgggtaacccccgttcgggttaacccccg

SEQ ID NO: 408273 - DNA, 667 bp, Homo sapiens
  misc_feature: GZ8MTXP01DU1CH.52.12.B01.1.454.CMB.2.raw
  modified_base (306)..(306): a, c, t, g, unknown or other
  modified_base (637)..(637): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctgagataagtggggaataatattgttcctgtatcagcagaagccaggccacgtcccctgtcgttggtcatctatcaaagatacaagagcnccgtagacgggactccctggacgcgtacttcgtcgtcggtaccctcccgaacgtccggtacgggggaaaccaaccgaacggaccccctaaccgttccgttacggtaaaccccacgttacccggaaccggggaccccgggggaaacccctaaacggtaaccccgtttcgtacggggaacgttagaacggggtccttaacgggtaactttaacgtttacgtacgggttacgacggggtacgtcggggaaccaggcgtaaacgggccggtaacggggggttgtaaccggggacgggaacgggaccttaaggcgttacgacccgttcgttacggnacgccgaggccttccgtccccgttgtcccg

SEQ ID NO: 408274 - DNA, 638 bp, Homo sapiens
  misc_feature: GZ8MTXP01DK6E8.52.12.B01.1.454.CMB.2.raw
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataaagttgggggaataaatattgttctggtatcagcagaagccaggccacgtcccctgcgttggcatctatacaaagactaaccgaagacgggcgcgtacgagggactccgtgacgcgtattcgtctggtaccctaccaacgtcggtacggggaacacgacgccactctacgaccatcgacggccggaccagactcgtggatgacggctacgtaacttagttacgtgtacggtaggcggtcgggacgagccgagggtaccggggtacggggggttcggttaaccgggggacggggaaccgggggaacccgaaacgggtccggtaaccggttacccggttccggttaacgggtaacccgaaccggaaccccggtaacgggtccgttaccccggtccccccggttcgggttaaccccg

SEQ ID NO: 408275 - DNA, 624 bp, Homo sapiens
  misc_feature: GZ8MTXP01ES9YE.52.12.B01.1.454.CMB.2.raw
  modified_base (222)..(222): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtcgtccccaggacagacagccagcatcacctgctctgganataagtaggggataatattgttctggtatcagcagagccagccacgtccctgcgttgctatctatacaaagactaaccgaagacggcgtctacggacgggtactccccgtagtacggctagtttccgtcgtcggtacccttaccgaacgttcggtacggggaccacgtaccgccgactctacgacacacgacggacccggaccacgtaacgtcgtaggacgttcgagggtactaggtacttaacgttacgttacggtacgaacgggtcggtcgggaccgaagcggtaaggccggggtacgggggtcgggttaacggggcgggagggaccaaggccgtacgggacccgttcggcggtaaccgacgcccgaacggtccgaccccgtccccgttaaccgggtccc

SEQ ID NO: 408276 - DNA, 773 bp, Homo sapiens
  misc_feature: GZ8MTXP01BGMF1.52.12.B01.1.454.CMB.2.raw
  modified_base (455)..(455): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagttcgtccgtcgtccccaggacagacagccagcatcacctgctcgtaggagaagttaaagttgggggaattaaagttagtttcgtttccttaggtatcgagacaaggaacgccgacggcccacgttcccccgtggtccgtttggtactattactaagttaccaaacggtaacttaacccgaaaggacggtaccgtccgtacgaacggggtacctcccgtggaaccgtccgtacttctcgtcggtaacccttaccgaacgtcggtacggggacctacgacnccctaactccgtacgaacctacgcgaacgggacccggaacccgagtaccgttcgaggacttagggacggtacgttacggttaaccgttagtttacccgtaggttacggacggggttaccggtacgggggactaaaccgggcggaaccggggtaccggggttacccggggggttacgggttaaccgggggaacccggggaacgggggacccgttaaacgggtccggttaacccgggttaaccccggtttccggacggttaacccgaccgttaacccggaacggtcccgttccccggtaacccccgttcgggttaacccc

SEQ ID NO: 408277 - DNA, 670 bp, Homo sapiens
  misc_feature: GZ8MTXP01BOFOV.52.12.B01.1.454.CMB.2.raw
tcagcgcagtacgacacgaccggtgctcgatttagtagtgtagattccgcgggcacgaccggtgctcgatttagtagtgtagatttgggtttggggagtcccagtcaggacacagcatggacatggacgggtccccgctcagctccgtggggctcctgctgctctggctcccaggtgccagatgtgacatccagttcgacccagtctccacttcccttcctgtctgctatctggtaggagacagagtccaccatcacgtcggcccggcaggtcgagggctagttagcgtaagtttattacgccgtaggtactacgaagaaaccaaaaaaccgaagggaaaccgtaccccgtaagccttccgtagtactcgtagtggtacactatacctaacgttgaacgtaagggtcgggtacccaagtacgtacggtacgacgggcgtagaggtcgacgtcggaacggaactaacgttaacttaccacttaccaaacaaacgtactacgaccgtacgaacgttcccgagaccgtacgtaccgttaaggttaactttacgttaactacgtttaaactttcttactaactaaccttaactttaaacttagtttaaccttcctttaccgttcgttccggtcccgacgtaacggtaacgagttacgtaacttaacgtaaaccg

SEQ ID NO: 408278 - DNA, 711 bp, Homo sapiens
  misc_feature: GZ8MTXP01BAZSU.52.12.B01.1.454.CMB.2.raw
  modified_base (675)..(675): a, c, t, g, unknown or other
  modified_base (693)..(693): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcacgccaccctcagtcgtccgtcgtcccaggacagacagccagcatcacctgctcgtaggagagtaaaggtaggggtaattaaatattgttacctggtatcgagacagaacgcacgaccacgtcccctgcgttgactatactatacaagaactaccgaaggacggcgaccgtacgaacgggactcccgtagaccggcgtacgttccgtaccgtcggtaccctaaccctaaccggtcggtacgggggtaacccaaccgtacgacccctaacgttacccgtaccgaacccgtaactccgggaacccgggtacccggggaaccccgtaacggtaccggttaccggttagggaacggtcggggtaaaccgttcgttaaacggttaactttacgttaaccggttacggttacgggacggggtaccggtacggggacacgggacgcgggggtaccggggtacgggggtcggtaaccggggacgggacgacgttacgacggtacgaccgttgttaccgngtaccgaaccgcggtccncccgtcccgttcgtcccg

SEQ ID NO: 408279 - DNA, 656 bp, Homo sapiens
  misc_feature: GZ8MTXP01ANFY4.52.12.B01.1.454.CMB.2.raw
  modified_base (417)..(417): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagcccaccctcagtcgtccgtcgtccccaggacagacacgccagcatcactgctcgtggagataagttaggggaataaatattgtttccgtggtatcagcagacgcaggccacgtcccctgcgttgcatctatacaagactaacccgaaggcggtcgacgtacgaacgggtctcccgtagaaccgtcggtacttcctcgtcggtaacctaccgtaacgtcggtacggggacacgacgcctactctacgaaccngaccgacggtaccgacagtactcgagacgtcgacgtactacgtacgttacgtacggtcggacggtacggcgggtacggacgacgggacggttacggggtccggggtacgggggttcgggaacccgggggaacggggttaaccgggaaccgacggtaccggtacccggacccggttcggaccggaacccgtaccggaaccccggtacggtccccgttccccggtccccgttaacgtcccg

SEQ ID NO: 408280 - DNA, 621 bp, Homo sapiens
  misc_feature: GZ8MTXP01CVWYS.52.12.B01.1.454.CMB.2.raw
  modified_base (406)..(406): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttcgacccagtcctccactccttcctgtctgcatctgtagagacagagtcaccatcacgttcgccggcagcgagggctagtagctagttattcgccgtaggtatacaagaaccaaaaccgaggaacacccctaagcctacctagtactacgtagtcggtacactagtactaacgtttcgaacgtaagggtcggaccctagtacgaaggtcagcgnaggtgatgaggaacagtaattcacttcacaatactacgacgcgtaacgccgttacgaccgtaacgtccgtaagtaagtttactttacggtaaacccttaaatttacctaacgtaactaaccaaacctttaccttaagttaaacccgttccttacccgttacgttacccgtttccgggacctaacgggaactaaggcgtaaacttaacgtaaaccg

SEQ ID NO: 408281 - DNA, 735 bp, Homo sapiens
  misc_feature: GZ8MTXP01DJJAL.52.12.B01.1.454.CMB.2.raw
  modified_base (231)..(231): a, c, t, g, unknown or other
  modified_base (570)..(570): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacgttcggccgggcagtcagggctattagctagttattagcctggtatcaagaaccaaaaaccgagggaaacacccctaagcctaccgtagactctagtggtacgacctatacctaaacgtttcggaaccggtaaacggggtttccggggtacccctaagttaaccggtaaacgggttccgaacgggtccgggtacgtaaggtacgggtacttaccgggagggtaactaaggtaaacttctaaacctctacaaactaatacgacgtacgaacggtccctagaccacgtccgtaagtaacgtttactttacaactttaaaccgttnttaaccgtaactaaacccttaaaaccggtttaaccttttaaagttaacccgttttacccttaccccgttttccgttaacccgggttttaaccccgggaaccccggttaaacgggtaaaaccccggttaaaggttacggtaacccttaaaccgttaaaaacccggg

SEQ ID NO: 408282 - DNA, 589 bp, Homo sapiens
  misc_feature: GZ8MTXP01EEHWC.52.12.B01.1.454.CMB.2.raw
  modified_base (463)..(463): a, c, t, g, unknown or other
  modified_base (495)..(495): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcagggcattagctagttatttacgcctggtatcgaagaaccaaaaaaccgagggaaacgcccctaaagcctacctagactctaagtggtcgactatactaactttggaacgtaaagggtcggggtacccctaagtaccgtaacggttcagggcggacaggtgatcgaggacagtaattcactcacaacaatcagacacgtccgtnaccgagtccgtagaagttatttgactaacttntactaagtaccaaactactttaatacgttaccttccttcttaccgtttccggaccccgtaagggtaacccaaggttacgaacttaagtaaaccg

SEQ ID NO: 408283 - DNA, 562 bp, Homo sapiens
  misc_feature: GZ8MTXP01DWONX.52.12.B01.1.454.CMB.2.raw
  modified_base (135)..(135): a, c, t, g, unknown or other
  modified_base (311)..(311): a, c, t, g, unknown or other
  modified_base (319)..(319): a, c, t, g, unknown or other
  modified_base (341)..(341): a, c, t, g, unknown or other
  modified_base (395)..(395): a, c, t, g, unknown or other
  modified_base (423)..(423): a, c, t, g, unknown or other
  modified_base (434)..(434): a, c, t, g, unknown or other
  modified_base (473)..(473): a, c, t, g, unknown or other
tcagcgcagtacgacacgaccggtgctcgatttagtagtgtagattccgcgggcacgaccggtgctcgatttagtagtgtagatttgggttggggagtcccagtcaggacacagcatggacatgagggtccccgntcagctcctggggctcctgctgctctggctcccaggtgccagatgtgacatccagttcgacccagtctccatccttcctgtctgctatctggtagagacagagtcaccatcacgttgccggtcagtcaggctatagctagttatacgctggtatcaagaccaaaaacgaggaaacncccgtaanctcctagtactactagtggtcnctatactaagttcgaacgtaggtcgggtaccagtacagtcagcgacagtgtacncgaggactagtactcactcacacgatcncacgatccgtnaccgatccgtagtaagttatttgaacttaacttattacngttaccaaactaacttagtaactttccttaccttcttacgtttaaccggcttaacgggaacctaaggttacgtaacttaacgtaaaccg

SEQ ID NO: 408284 - DNA, 678 bp, Homo sapiens
  misc_feature: GZ8MTXP01BB3Z6.52.12.B01.1.454.CMB.2.raw
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcacgccaccctcagtcgtcccgtcgtccccaaggacagacagccagcatccacctgctcgtaggagtaagttaaaggttggggaattaaattagttcgtttcctaggtatcgagtacaacgaacgcccgacggcccacgtccccgtgtcgttggctatctaatacaaagtactaacgaagcggcgtcgtacgacggtactccgtagaccgcgtattccgtcgtccgtacctaccgaacgtcggtacgggacaccgacgtaccacttcacgactacgcgacgggacccgaacacgtcttcgaggattcggacggtactacggtacttacgttacgtcggaccggtagggtacggtacggacgaacgggtcgtaacggggtccggggtaacgggggtcggtaaccggggaacgggttaccgggaaaccgttcggtaccggtccggttacccgttcggacgtaacccggaccgaaccggaccggtcccgttcccggtaaccccgttcggttaaccccg

SEQ ID NO: 408285 - DNA, 686 bp, Homo sapiens
  misc_feature: GZ8MTXP01ALXU3.52.12.B01.1.454.CMB.2.raw
  modified_base (472)..(472): a, c, t, g, unknown or other
  modified_base (524)..(524): a, c, t, g, unknown or other
  modified_base (537)..(537): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagattgggggacatccagttcgacccagtcctccacttcccttcctgtctgctatcgtgtaggagacagtacgtccacctactcctacgttcgggacccggtcgacgtaccgagggacctagtacgcgtaagtttagttacgtcgttagtactacgaacgaaacctaaaaccggaacgggaaaccgtacccctaacgtcctaccgtagtacgttacgtacgtaggtccgactacttaaccgttaacgtttacggaaacggttaacggggtccgggtaccctagtacgtacgtacgnggcgagtagcgtatcggtagacgaataccgtcacttcacacgtaactgaacnccgagtcccgganacgtacgtacgtagtactttacgttactaactttaacttctacttaactaaccttaaactttaaccgtttacgttacctttacccttccgtttccgttacccggttaaccggaccgtaacgaacgtacggttactaacgttaactaacg

SEQ ID NO: 408286 - DNA, 760 bp, Homo sapiens
  misc_feature: GZ8MTXP01A45BL.52.12.B01.1.454.CMB.2.raw
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcacgccaccctcagtcgtccgtcgtccccgaggacagacagccagcatccacctgctcgtaggaagtaagtaaaggttgggggtaattaaagttagttacggtttcccgttagggtaacttcgaaggacaaggaacggcccgacgggaccctaccggttcccccgtcggtaccggtttcggtcacttcgtacgtaacaaggtaacgtaaccgaaggacgggcgtaccgtacgtacgggacctccgtaggtacgcggtattccgtacgtcggtacctaccgtaacgtcgtacggggacctacgacgacctacgtactaccgacctagtaccgacgggaccccggacccgacgtaccgtaccgtagggtaacgttcgggacggtacttacgggtaactttacgttaccggtacgtacccggtaggggacccggttaggggaccgacgggacccggtaggggaccgggttaccggggggtacgttaaccgggggacggggacccggggtaacaacgggtccggtaacccggttacccgttaccggttacggtaaccgccggaacccgttaggccccgttccgtccccggttaacgtcccg

SEQ ID NO: 408287 - DNA, 665 bp, Homo sapiens
  misc_feature: GZ8MTXP01ARK6T.52.12.B01.1.454.CMB.2.raw
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagcccaccctcagtcgtccgtcgtccccgaggacagacagccagcatcactgctctggagtataaagtaggggaataaatattgttcctggtatcagcagaagccaggccacgtccctgtcgttgcatctatacaagactaacgaagacgacgctacgtacggactccgagacgtccgtattcgtccgtacggtccctaaccgtaacgttcggtaccgggggtacaccgtaccggaccctacttacccgtacgaaccctaacgtaccggacggtacccgggaacccgaaaccgtcgtaccgttagggaaacgtggtaacggtcgtacgtaaccgggttatttacccgtagtccggaggtcgggtacgggacacggtcgtaacgggcgggtcgggggtcggtcggggacgggttacgggaacccgagggtcctacgggaccgttccgttacgggtaacgaccgtaacccgacggtccttcccggtccccgcggttaaccccg

SEQ ID NO: 408288 - DNA, 489 bp, Homo sapiens
  misc_feature: GZ8MTXP02IPY7O.52.12.B01.1.454.CMB.2.raw
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataaattggggataaatatgttcctggtatcagcagaagcaggccagtcccctgcgttggtcatctatcaagataccaagagcgctcagggatccctgacgcgattctctggcttccactctggggacacagccactctgaccatcagcgggacccagactctggatgaggctgactattactgtcaggcgtgggacagcagcgacggggtgtcggcggagggaccaaggcgtcgaccgtctaggcagccaggctcgcccctcggtcc

SEQ ID NO: 408289 - DNA, 557 bp, Homo sapiens
  misc_feature: GZ8MTXP02HXM3I.52.12.B01.1.454.CMB.2.raw
tcagcgcagtacgacacgaccggtgctcgatttagtagtgtagattccgcgggcacgaccggtgctcgatttagtagtgtagatttgggtttgggagtcccagtcaggacacagcatggacatgagggtccccgctcagctcctggggctcctgctgctctggcctcccaggtgccagatgtgacatccagttgacccagtctccatccttcctgtctgcatctgtaggagacagagtcaccatcacttgccggcagtcagggcattagcagttattagcctggtatcagacaaaaaccgaggaaaacgcccctaagctcctgatctatggtgctatcaactttgactaagggtggggtcccatacgaagttcgaggcgacgagtgactcgtggggacaagtaaatttccgaacttctacaacaactacacgacgaacgtccctaggacacgtacctagaaacgtttatttagacttaaacttattactgtactaaactacttaaattacttactccttactacgttccgccgtaggacctaaagtcgacactaacg

SEQ ID NO: 408290 - DNA, 512 bp, Homo sapiens
  misc_feature: GZ8MTXP02JZCL7.52.12.B01.1.454.CMB.2.raw
  modified_base (214)..(214): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttccngtctgcatctgtaggagacagagtcaccatcacttgccggcagtcagggcattagcagttattagcctggatcagcaaaaccagggaaagcccctaaagctcctgatctatggtgcatcaactttgactaaggtcgggggtcccagtcgaaggttcagcggcagtgatcgtgggacagatcactctcacaatcagcagcctgcagcctgaagtatttgactaacttattactagtcaaactacttaaatacgttactccttctacttcggccttagggaccctaagtcgacataaccg

SEQ ID NO: 408291 - DNA, 587 bp, Homo sapiens
  misc_feature: GZ8MTXP02HUCR5.52.12.B01.1.454.CMB.2.raw
  modified_base (135)..(135): a, c, t, g, unknown or other
  modified_base (229)..(229): a, c, t, g, unknown or other
  modified_base (293)..(293): a, c, t, g, unknown or other
  modified_base (300)..(300): a, c, t, g, unknown or other
tcagcgcagtacgacacgaccggtgctcgatttagtagtgtagattccgcgggcacgaccggtgctcgatttagtagtgtagatttgggtttgggagtcccagtcaggacacagcatggacatgagggtccccgntcagctcctggggctcctgctgctctggctcccaggtgccagatgtgacatccagttgacccagtctccatccttctgtctgcatctgtagganacagagtcaccatcactgccggcagtcaggcatagcagttattagctggtatcagacaaaaacnggaaaancccctaaagctcctgatctatggtacacatactaattgacgtaagggtcggtaccatacgtaagttcacgcgacgtagtgtatcgaggactaagtacttcactcacaactaagtacgacgacgacgacgtacgacgacgtacgtacgtaagttaacgtttacgtaacttaacttaacttaacgttacgtaactaaacctaaaccttaaacttaacgttaccttaccttaccttaccgttaaccgtacccgtaccggtaaccgtaaacgtacgtaacgtaacgtaacg

SEQ ID NO: 408292 - DNA, 491 bp, Homo sapiens
  misc_feature: GZ8MTXP02F3Z0K.52.12.B01.1.454.CMB.2.raw
  modified_base (329)..(329): a, c, t, g, unknown or other
  modified_base (383)..(383): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccacccttagtgtccgtgtccccaggacagacagccagcatcacctgctctggagataaattggggataaatatgttctggtatcagcagaagccaggccagtcccctgcgtggtcatctatcaagataccaagaggcgctcagggatccctgagccgattcnctggctccaactcgtggggacacgagccactctgaccatcagcggacccagacnctgatgagctgactatactgtcaggcgtgggacagcagcgacgggggtgtcggcggaggaccaagctgaccgtctaggtcaagccgaaggctcgcccctcggtctccg

SEQ ID NO: 408293 - DNA, 549 bp, Homo sapiens
  misc_feature: GZ8MTXP02H34EZ.52.12.B01.1.454.CMB.2.raw
  modified_base (298)..(298): a, c, t, g, unknown or other
  modified_base (306)..(306): a, c, t, g, unknown or other
  modified_base (382)..(382): a, c, t, g, unknown or other
  modified_base (453)..(453): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcagggcatagcagttattagctggtatcagacaaaaacgnggaaaacncccctaagctcctgatctatgtcgactatctaactttgacgtaagggtcgggtacccatccgtaaggtcaggcganagtgatcgtagggaacagtaacttcactctacacaatcaagcaggtccctgacagctaagaattagtttanacttaattactactactaactaactaactttaatacgttacctccttactaccgttccggaccgtacgggaacctaaggtaccgaactaacgaacg

SEQ ID NO: 408294 - DNA, 495 bp, Homo sapiens
  misc_feature: GZ8MTXP02HI5DA.52.12.B01.1.454.CMB.2.raw
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataaattggggataaactatgttctggtatcagcagaagccaggccagtcccctgcgttggtcatctatcaaagataccaagaggcgctcgagggatccctgacgcgattctctggctccactctggggacacagccactctgaccatcagccgggacccagactctggatgaggctgactattactgtcgagcgtggacagcagcgacggggtgtcgggcggagggacaggctcgaccgtcgagtcacgccgaacgcctcgccccgtcggtcc

SEQ ID NO: 408295 - DNA, 538 bp, Homo sapiens
  misc_feature: GZ8MTXP02HLZQA.52.12.B01.1.454.CMB.2.raw
  modified_base (416)..(416): a, c, t, g, unknown or other
  modified_base (432)..(432): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataaagttggggataaatatgtttctggtatcagcagaagccaggccagtcccctgcgttggtcatctatcaagataaccaagagcgctcagggactccgtgacgcgattctctggcctcactcgtaggggacacacgccactctcgaccatcagccggacccagactcgtggatcgagtctagtactagtttcngtcgaggcgtcggganacggcgaggcgtacgggggtcgtcgggcgggagggaccaggacctcggaccggttccgaggtaaccgacggacccgaacgggcctacccgcccccggtacggtccc

SEQ ID NO: 408296 - DNA, 569 bp, Homo sapiens
  misc_feature: GZ8MTXP02JMD8V.52.12.B01.1.454.CMB.2.raw
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataatggggataaatatgtttctggtatcagcagaagccaggccagtcccctgcgttggtcatctatcaagactaccaagaggcgctcgagggactcccgtgacgcgattctcgtggcctcactcgtggggacacagccactctacgaccatcgacggacgggacccagacctcgtaggaatggaagggtcctaggtaacttatttaccgtgtccgaggccggtagggacaggccgaaggcgggtacgggggtcgttaccggggcggggaacgggacccgaaaggccgttacggaacccggttcgtaacggggcacggacccgaacggcctcggcccccgtcggtccc

SEQ ID NO: 408297 - DNA, 571 bp, Homo sapiens
  misc_feature: GZ8MTXP02I46OS.52.12.B01.1.454.CMB.2.raw
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataattggggataatatgttctggtatcagcagaagcaggcagtcccctgcgttggtcatctatcaagataccaagacgcgctcaggactccctgacgcgattctctggcctccactcgtggggacacgagccactctagacctatcgacgccgggacccaggacctcgtaggatagagctacgaacttagtttaactgtccgaggccgttaggggacaggaccaaggcgacgggggttcgttacggggcgggacggggacccgaaaggcgttacgacccggttccgttaaacgggtccgaaccggacccgtaaacggggtcccccgtacccggtcccccgttacggtcc

SEQ ID NO: 408298 - DNA, 492 bp, Homo sapiens
  misc_feature: GZ8MTXP02IY2KM.52.12.B01.1.454.CMB.2.raw
  modified_base (431)..(431): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataaattggggataaatatgtttcctggtatcagcagaagccaggccagtcccctgcgttggtcatctatcaagataccaagaggcgctcagggatcctgacgcgattctctggctccatcgtggggacacagcactctgacatcagcggaccagactctgatgagctagactattactgtcaggcgtgggacagcgagcgacgggggtnttcgggcggaggaccgaagcgtcgaccgtcgtaggcgacgccaagggctcgccctacggtc

SEQ ID NO: 408299 - DNA, 593 bp, Homo sapiens
  misc_feature: GZ8MTXP02GR1B7.52.12.B01.1.454.CMB.2.raw
  modified_base (336)..(336): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggccagtcagggcatagctagttattagcctggtatcaagacaaaaaccgagggaaaacgcccctaagctctgatctaggggtntcgctatactaactttgacgtaagggtcggggtccctagtacgtaaggttcaggcggcaggtggaacgtcgtaggggaacaagtaacttccgactctacaacaactacacgcacgtcctgaccacgccgtagtaagttacttttacgacttaactttacttactactacctaaactaacctttaaattacgtttaccttaccttacctaccgttccggcccgtaacggtaaccctaaagtcggaactacgtaaaccg

SEQ ID NO: 408300 - DNA, 506 bp, Homo sapiens
  misc_feature: GZ8MTXP02IRGCM.52.12.B01.1.454.CMB.2.raw
  modified_base (398)..(398): a, c, t, g, unknown or other
  modified_base (424)..(424): a, c, t, g, unknown or other
  modified_base (446)..(446): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataaattggggataaatatgtttcctggtatcagcagaagccaggccagtccccctgcgttggtcatctatcaaagataccaagaggcgctcagggatccctgacgcgattctctggcttccactctcggggacacgacgccaatcagaccatcagcggacccagctctgatgagcngactattactgtcgaggcgtgggacngcagcgacgggggtgttcgggnggacggaccaagcgtcgaccgtcgtaggtcgacgacccgaaggcctccgcccctcggtcc

SEQ ID NO: 408301 - DNA, 528 bp, Homo sapiens
  misc_feature: GZ8MTXP02G1KAK.52.12.B01.1.454.CMB.2.raw
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataaatggggataaatatgtttctggtatcagcagaagccaggccagtcccctgcgttggtcatctatcaagataccaagaggcgctcgagggatcccgtgacgcgattctcgtggcctacactcgtaggggacacgagccactctagaccatcgacgcgggacccagacctcgtgatcgaggctgactattagtgtacgaggccgtagggacaggcgagcggacgggggtcgtcgggacggaggaccaaggctcgaaccgtcgacggtcgacgtcccgaagggtccaccggccccgtcggtacccg

SEQ ID NO: 408302 - DNA, 492 bp, Homo sapiens
  misc_feature: GZ8MTXP02IURSM.52.12.B01.1.454.CMB.2.raw
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctgagataatggggataaatatgttctggtatcagcagaagcaggccagtcccctgcgttggtcatctatcaagataaccaagaggcgctcagggatccctgagcgattctctgctccactctggggacacagccactctgacactcacggccgggacccagacctcgtggatgagctagacttattactgtcagggcgtgggacagcgagcgacgggggtgttacggcggagggacagctcgaccgtcgtagcgacgccaggctcgcccgtcgtcc

SEQ ID NO: 408303 - DNA, 568 bp, Homo sapiens
  misc_feature: GZ8MTXP02IEBNX.52.12.B01.1.454.CMB.2.raw
  modified_base (230)..(230): a, c, t, g, unknown or other
  modified_base (299)..(299): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttcctgtctgcatctgtaggnacagagtcaccatcacttgccggccagtcagggcatagcagttattagcctggtatcagacaaaaaccnggaaaagcccctaaagctcctgatctatgtgacatcaactttgcaaggtggggtcccatcaagttcagcgcagtgatctgggacagaattcaactctacacaatcaagcaagctcgacagtcccgtagtaaggtagtttacgtactaacctttaatttaacttacgttactaaactaacctttaaacttaaacgtttaaccttaacctttccttaacctttccgtcccgttaccggtacgtaaaacgttacgggacgtaacttaaaccg

SEQ ID NO: 408304 - DNA, 603 bp, Homo sapiens
  misc_feature: GZ8MTXP02IFV5E.52.12.B01.1.454.CMB.2.raw
  modified_base (215)..(215): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttcgacccagtctccatccttccngtctgcatctgtaggagacagagtcaccatcactgccggcagtcagggcattagctagttatttagccttggtatcagaacaaaaaccgaggaaaacgcccctaagcctacctgtaactctaagtggtcacactctaactttggacctaaggggttccggggtaccagtaccgtaaggttccgagcggcaggtgatcgtaggacaagtacttcacttcacaactaatcagtcaggcctagacacgtccgtagtaacgttagtttcgaacttaaactttactttaaccgtagttacctaaaacttaacctttaaagttaactttacctacctttactaccgtttaaccggacccgtacggtaaaccaaggttacgaactaacgtaaacg

SEQ ID NO: 408305 - DNA, 561 bp, Homo sapiens
  misc_feature: GZ8MTXP02JUCCL.52.12.B01.1.454.CMB.2.raw
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataaagttggggataaatattgttctggtatcagcagaagccaggccacgtccccctgcgttggtcatctatacaagactaaccgaagaggcgctcgagggactcccgtgacgcgtattctcgtcggctaccacgtcgtaggggaccacgacgaccactcacgaccatacgacgaccgggacccagcctacgtaggatgaggctagactatactgtacgaggcgtgggacaggcaggacggacgggggtcggttacggggcgggaggggacccgaagccgtacggtacccgtccgtaggtccgacggacccgacggccgtccgcccccgtcggtaccccg

SEQ ID NO: 408306 - DNA, 518 bp, Homo sapiens
  misc_feature: GZ8MTXP02IKS0P.52.12.B01.1.454.CMB.2.raw
  modified_base (411)..(411): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataaattggggataaatatgtttctggtatcagcagaagccaggccagtcccctgcgttggcatctatcaagataaccaagaggcgctcgagggactccctgacgcgattctctggcctcactctagggaacacacgccactctgacatcacgcggacccagacctcgtgactgagctagactatttacngtcaggcgtaggacagcgagcgacgggggtgtcgggcggacgggaccaaaggcgtacgaccgtcgtaggtaacacggacccgaaggcctccggccccgtacggtccc

SEQ ID NO: 408307 - DNA, 708 bp, Homo sapiens
  misc_feature: GZ8MTXP02GJK31.52.12.B01.1.454.CMB.2.raw
  modified_base (517)..(517): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtcccgtgtcccccaggaccgacacgaccgacgcactaccacctcgtctccgtaggaggtaagtaaagttagggggtaaggtaaattaaagttgttttccgttcggttagttacagacgagaagaccgacggaccgaccgtccccgtccggtcgttacggtctactcttactactaaacgaataacctaacggaacggtcgccgtcgtacggaacgtccctcggaggcccggtattaccgttctcggtccgtaccctaaccttcggtacggggaccggaaaccaccgaccctaccgtcctacgtacccactaccgacgacccggggaccccgaagtaccnccgttaggagtggacggacgtactaacgttaattacgttgtacggacgggtcggtacgggacacggcgaacggcgggtaaccgggggtggttccgggacggggacggggaccgtaacggccgtacgccggtaccgtaggtaccgaaccgaccggaaccggtccgcccgtcccccgcccggttctaaccccg

SEQ ID NO: 408308 - DNA, 541 bp, Homo sapiens
  misc_feature: GZ8MTXP02IR7QG.52.12.B01.1.454.CMB.2.raw
  modified_base (308)..(308): a, c, t, g, unknown or other
  modified_base (333)..(333): a, c, t, g, unknown or other
  modified_base (413)..(413): a, c, t, g, unknown or other
  modified_base (438)..(438): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggccagtcagggcattagcagttattagcctggtatcagacaaaaaccaggaaaancccctaaagctcctgatctatggtncatcaactttgacgaaggtcggggtcccatcgaaggttcagcggcagtggatcgtgggactagaattcactctacacatnagcacgcctgcaacgcctagaagtntttacgacttaaacttattactcgtacaaactactttaaagttacttaccttaccttactacgtttccgacccgttaggaaccaaggtcggaactataaaccg

SEQ ID NO: 408309 - DNA, 543 bp, Homo sapiens
  misc_feature: GZ8MTXP02F5RBV.52.12.B01.1.454.CMB.2.raw
  modified_base (403)..(403): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataaattggggataaatatgtttcctggtatcagcagaagccaggccagtccccctgcgttggtcatctatcaagataccaagaggcgctcgagggactcccgtgacgcgattctctggccttccactcgtcggggacacgacgccactctgaccatcacggccggacccagactctggagngagtctagtacttattcgtgtcgacggcggtggacaggacgacgggacgggtacgggggtcggtcggggacgggacgggaccgacgccgtacggacccgtcgtacggcgacggaccgacggccgtccggccccgtcgtcc

SEQ ID NO: 408310 - DNA, 529 bp, Homo sapiens
  misc_feature: GZ8MTXP02G6S6I.52.12.B01.1.454.CMB.2.raw
  modified_base (310)..(310): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcactggccggccagtcgagggcattagctagttattagcctggtatcagacaaaaacgaggaaacncccctaagctctgatctatggtcgcatctaactttgacgaagggtcggggtacccagtacgaaggttcaggcggactaggtggatcgtagggacagtaacttcactctacacaatacagcagcctgacagcctagaatatttcgacttaacttattactacgtaccaactacttaatacttactccttctacttcgcctacggacaagtcgacataacg

SEQ ID NO: 408311 - DNA, 544 bp, Homo sapiens
  misc_feature: GZ8MTXP02H8KUA.52.12.B01.1.454.CMB.2.raw
  modified_base (299)..(299): a, c, t, g, unknown or other
  modified_base (306)..(306): a, c, t, g, unknown or other
  modified_base (331)..(331): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctccaggtgccagatgtgacatccagttgacccagtctccatccttcctgtctgcatctgtaggagacagagtcacatcacttcgccggcagtcagggcatagctagttattagctggtatcaagacaaaaacgnggaaacncccctaagctctgatctagtggtcncatctaaacgtttgacgtaagggtcgggtaccatacgtaagtcaggcgacagtggaatcgtacggggaactagtaactcaacttcacacaaatccagcacgtcctgacacgctagtaagtatttcgaacttaacttatactacgtactaaactaaacttaatacttacctccttactaccgttcgacctacggactaaagtcgaactataacg

SEQ ID NO: 408312 - DNA, 739 bp, Homo sapiens
  misc_feature: GZ8MTXP02G55SU.52.12.B01.1.454.CMB.2.raw
  modified_base (306)..(306): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcactgccggcagtcagggcattagctagttattagcctggtatcagacaaaacgaggaaacncccctaagctcctagatctagtggtcactagtctaacgtttggacgtaacggggtcgggggtacccctagttaccgtaaagggttcgaacgggccgggtacgtaagggtgggtacgttcggtagggggaacctaaggtaaactttaccacttacctaccaaactaacgtaccacggaccacggtcctacggaccgtaacgacccgttaaggtaagtttacttttacggtaaccttaaacttttaacgtttaacttaccggttaaacccttaaaaccgtttaaacccttttaaaagtttaacccgttttaaccctttaccccgttttaaccgtttaaccccggtttttaacccgggtaacccccggtttaacgggggttaaaaccccgtaaaacgggtttacccgggaaaaccttaacggtttaaaaaccccgg

SEQ ID NO: 408313 - DNA, 697 bp, Homo sapiens
  misc_feature: GZ8MTXP02FRT96.52.12.B01.1.454.CMB.2.raw
  modified_base (231)..(231): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttcggccggcagtcagggcattagctagttattagcctaggtatcgaagaaccaaaaaccgaggggaaaactcccccttaaaggcctaccgttagaacttccgtaagtcggtacgactaacgtactaaacgttttgacgtaaacggggtcggggtaccccagttaccgaaacgggtttccaaagggtccggtaacgtaggttacgggtacgttacgggtacgggggaaacaagttaaaacttccgtaacctttacctaacgaaacgtaaacttaccgaacggtaccaacggtccctagggacctaggtaccctagtaaacggttacttttacggacttaaaccgtttataaccgtctaacctaaactaaccctttaaagttacttaccttaccttaccttaacgttccgaccgttacggtaaaacctaaggtacgaactacgtaaacccg

SEQ ID NO: 408314 - DNA, 548 bp, Homo sapiens
  misc_feature: GZ8MTXP02GT9HF.52.12.B01.1.454.CMB.2.raw
  modified_base (305)..(305): a, c, t, g, unknown or other
  modified_base (312)..(312): a, c, t, g, unknown or other
  modified_base (466)..(466): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttctgtctgcatctgtaggagacagagtcaccatcactgccggcagtcagggcatagcagttattagcctggtatcagacaaaaaccgaggaaacnccctaanctcctgatctagtggtcgacatctaactttgacgtaagggtcggggtacccatacgtaaggttcacgcggataggtggaattcggaggggaacaagtaattccaacttcctacaactaaactacagacaagcctagcagtcctagaatgtttanactaacttataactcgactaaacactttaatacgttacctcttactacgtttccgacctaggacctaagtcgacataaaccg

SEQ ID NO: 408315 - DNA, 540 bp, Homo sapiens
  misc_feature: GZ8MTXP02F4TI9.52.12.B01.1.454.CMB.2.raw
  modified_base (232)..(232): a, c, t, g, unknown or other
  modified_base (314)..(314): a, c, t, g, unknown or other
  modified_base (339)..(339): a, c, t, g, unknown or other
  modified_base (388)..(388): a, c, t, g, unknown or other
  modified_base (425)..(425): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttcgacccagtctccatccttcctgtctgcatctgtagganacagagtcaccatcacttgccggccagtcagggcattagcagttattagccttaggtatcaagacaaaaaccgagggaaacncccctaagctcctagatctatggcncatctaactttgacgaagggtcggggtcccaatcgaaggttcagcgganagtgatcgaggacaagtaactcactctacaacatcancacgcctgacagcctagaagtatttacgactaactttattactatacaaactacttaaatacttaccttctctaccgttccggaccctagggaaccctaaggtcgacactaaacg

SEQ ID NO: 408316 - DNA, 599 bp, Homo sapiens
  misc_feature: GZ8MTXP02JXA6U.52.12.B01.1.454.CMB.2.raw
  modified_base (231)..(231): a, c, t, g, unknown or other
  modified_base (329)..(329): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttcctgtctgcatctgtagganacagagtcacatcacttgccggcagtcagggcatgcagttattagctggtatcagacaaaaaccgaggtaaacacccctaagctcctgatcagtggcnctatactacgttgacgtagggtcggtacccagtacgtaaggttcacggcggtacgtaggtacggtagtcggtagggaactaagtaacttccaacttcgtacaactaatcgagtaccacgccgtcgcgacgtacgtacgtagttatttacgtacttaacgttaacgttacttacgtaacctaaacctaaacttaaacttacgttaccttaccttaccgttaccgttccggtacccgtaccggtaacgtaacgtacgtaacgtaacgtaacg

SEQ ID NO: 408317 - DNA, 669 bp, Homo sapiens
  misc_feature: GZ8MTXP02GWRDB.52.12.B01.1.454.CMB.2.raw
  modified_base (297)..(297): a, c, t, g, unknown or other
  modified_base (305)..(305): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcactgccggcagtcagggcattagcagttattagcctgtatcagacaaaaacngggaaacncccctaaagctcctagatactagtggtcactatccgtaaacgtttcgacgtaaacggggttcgggggtacccctaagtaccggtaaaggtttccgaagggtccgggacgaaaggtcgggtaaagtttccggagggggtaaccaaggtaaactttccaacctttacacctaaacaaacggttccaggacctaacgggtccctacgacgacgtaccgtacgtaacgttaacgtttacgttacttaactttaacttaacgttacgtaacctaaaccttaaaccttaaacttaacgtttaccttaccttaccgttaccgttaaccgtacccgtaaccggtaacgtaacgtacgtaacgtaacgtaacg

SEQ ID NO: 408318 - DNA, 528 bp, Homo sapiens
  misc_feature: GZ8MTXP02I8DCI.52.12.B01.1.454.CMB.2.raw
  modified_base (301)..(301): a, c, t, g, unknown or other
  modified_base (308)..(308): a, c, t, g, unknown or other
  modified_base (333)..(333): a, c, t, g, unknown or other
  modified_base (402)..(402): a, c, t, g, unknown or other
  modified_base (407)..(407): a, c, t, g, unknown or other
  modified_base (427)..(427): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggccagtcagggcattagcagttattagcctggtatcagacaaaaaccnggaaacncccctaagctcctgatctatggtcncatcaactttgacaagggtggggtcccagtcaagtcagcggcagtgatcgtgggacagattcatcacanatcancagcctgcagcctaggaatntttacgactaaacttattactacgtacaaactacctttaaatactttactaccttctacgtttccggccctaggggacccaaaggtcggaactataaaccg

SEQ ID NO: 408319 - DNA, 555 bp, Homo sapiens
  misc_feature: GZ8MTXP02FYRI0.52.12.B01.1.454.CMB.2.raw
  modified_base (221)..(221): a, c, t, g, unknown or other
  modified_base (407)..(407): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctgganataagttggggataaatatgttctggtatcagcagaagccaggccacgtcccctgtcgttggtcatctatacaagataaccgaagaggcgctacgagggactcccgtgacgcgtattctctggcctccacgtcgtcggggacacacgaccactctcgacatcgacgccggaccagactcgaggtanggaacggtctacgaacttacgttacgtgtacgaggggccgtaggggacaggcgaggcggtacgggggtcggtacggcggggacggacgaacgcgtacgacccgtcgtaggtaaccgacgaccgtacggcctccgccccgtacggtacc

SEQ ID NO: 408320 - DNA, 662 bp, Homo sapiens
  misc_feature: GZ8MTXP02HTM0L.52.12.B01.1.454.CMB.2.raw
  modified_base (237)..(237): a, c, t, g, unknown or other
  modified_base (243)..(243): a, c, t, g, unknown or other
  modified_base (247)..(247): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataagtgggataaatntgttcngtancagcagaagccagcacgtcccctgcgttgcatcatacaagatacgaagagcgctgaacgggtctcccgtgacgcgtacttctacgtggcctcctacgtcgtacggggacacgagcccgactctacgaccagtccaacggcccggaacccagcgtacgtggagtcggcgtacgtacgtaattaacgtttacgtacggtacgaacggggtcgaacggggaaccgacggaccgacggggaacccgggtcgggggggttaaccgttccgggggaaacgggggaaaccgggggaaacctaaacggggtccggttaccggggaccccggtttaccccggaagggtaacccgaaaccgggttaaccccgtaaaccgggggcccctaacccccgggttccccccgttacggggtttaaccccc

SEQ ID NO: 408321 - DNA, 637 bp, Homo sapiens
  misc_feature: GZ8MTXP02GBZ06.52.12.B01.1.454.CMB.2.raw
  modified_base (317)..(317): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttcgacccagtctccatccttcctgtctgcatctgtagagacagagtcaccatcacgttgccggccagtcagggcagttagctagttattagccttggtatcaagaacaaaaaccgagggaaaccncccctaagcctcctagactacgtagtggtcactactactaaacgtttgaccgtaaggggtccggggtacccagttacgtaagggttcaagggcggactaggtggtacgtacgtagggaactaagtacttcctacttactacaaactactaccgacgacacggtcctacgacgtacgtaccgtaggtaaacgtttacttttacgaacttaaactttacgttaacgtactaactaaaccttaactttaaacgtactttacctacccttcgttaaccgttccggacccgtacggtaaaccgtaagtacgaactacgtaaaccg

SEQ ID NO: 408322 - DNA, 683 bp, Homo sapiens
  misc_feature: GZ8MTXP02FFVXS.52.12.B01.1.454.CMB.2.raw
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccacctcagtgtccgtgtccccaggacagacagccagcatcactgctctggagataaagtggggataaatattgttcctggtatcagcagaagccaggccacgtcccctgcgttggtacatctatacaagaactaccgaaaggacggcgcgtacgaggggctccccgtgacgcgtatctcgtggtcctacctacgtcgtacggggacaccgacgacctactctacgaaccgtactacgacggacccgggaaacccacggaaccgtccggttagggacgttacggacgggtctacggaaactttacgtttaacgtcggttacggaaggggtccggtaaggggacgaaacggcgaacgggaccgggggtaacggggggttcggttacgggggaccgggggaaaccgggaacccgaaacgggtccggttaccgggtaaccccggtaccgttaccgggaaccgaacggtaacccccggaaacgggacccgtttaccccggccccccttcggggttaacccc

SEQ ID NO: 408323 - DNA, 718 bp, Homo sapiens
  misc_feature: GZ8MTXP02I6MG7.52.12.B01.1.454.CMB.2.raw
  modified_base (231)..(231): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctctatccttcctgtctgcatctgtagganacagatcacatcactgcggcagtcaggcatagctagttattacgcctggtactacgacgaaccaaaaaaccgagggaaaaccgaccccgtaaacggtcctaccgttagtacttaccgtaaagtcggtacgtactacttaactaacgtttacgacggtaacggggttccgggggtacccctagtaacgtaaacggttccgaaggtccgggtacgtaggtgggtacttacgggtaggggacctaaagtaaccttaccaaccgttactaccaaactaactacgacggacacggtccgacgccgtaaccgtaccgttaagtaaaggttactttacgtaaccttaaactttacgtttaacgttaccgtaaaccttaaaccttaaaccttttaaaagttacctttaccgttacccttaccgtttacccgttaacccgggtaacccgtaacgggtaaacccgtaacggtaacggtaactaacgttaaaacccgg

SEQ ID NO: 408324 - DNA, 641 bp, Homo sapiens
  misc_feature: GZ8MTXP02HT8GD.52.12.B01.1.454.CMB.2.raw
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtcgtccccaggacagacagccagcactcacctgctcgtggagaataaagttggggaataaatattgtttctggtatcagcaagaacgccgacgccacgtccccgtgtcgtttggtcattctatacaagtactaacgaagacgcgctagaggtactccgtgaccgtcgtattctcgtcggtccttaccgacgtcggtacggggaccaccgacgaccctacttcacgaccacgtacgaacgggcccggaaaccctagtacccgttagtagggattacgggacgtacgttacggtaactttacgtttacgtcggtacgtacggggtcgtacgggacaaggccgaaggtcggggtaacgggggttcggtacgggacggggaacgggaccgtaacggtcgtaccggacccgttacgtacggtaacgaccgacccggacggcctcccggcccgtttacggtcccg

SEQ ID NO: 408325 - DNA, 684 bp, Homo sapiens
  misc_feature: GZ8MTXP02FVVCS.52.12.B01.1.454.CMB.2.raw
  modified_base (136)..(136): a, c, t, g, unknown or other
  modified_base (230)..(230): a, c, t, g, unknown or other
  modified_base (317)..(317): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgntcagctcctggggctcctgctgctctggctccaggtgccagatgtgacatccagttcgacccagtctccatccttcctgtctgcatctgtaganacagagtcacatcacttggccggcagtcagggctattagctagttattagccttggtactacgagaaccaaaaaccgagggaaaccnccccgtaaagcctcctagactactagtcggtacgcctaatacgtaacgtttgaaccggtaagggttccggggtccctaagtacgtaaacgggttccaagggtccggacgtaggtaggtactacgtaacgggaactaagttaaacttaccctaacgttaccgtacgaaaccaaagttacgacggaactaaccgccgttacggacaaacgtccgttagaaagttctttagaccttaaacgttacttaacgtactaacctaaacgttaaacctttaagttaacgtttaacccttccttacgttaaaccgttcccggtaaccgttacggtaaaacccggtaaaggtttacaacccggtaagttaaaacccg

SEQ ID NO: 408326 - DNA, 530 bp, Homo sapiens
  misc_feature: GZ8MTXP02GP0XT.52.12.B01.1.454.CMB.2.raw
  modified_base (332)..(332): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataaattggggataaatatgttctggtatcagcagaagccaggccagtcccctgcgttggtcatctatcaagataccgaagaggcgctcgagggatccctgacgcgattcnctggctccactcgtaggggacacgacgcccactctagacctactcacggccgggacccagactcgtggatgaggctagactagttactgtcgaggcgtgggacagctaggcgtacgggggtgtcgggacgggagggaccaaggcgtacgaccgtcgtacggtcgacggaccgaacggccgtacgcccccgtcggtccg

SEQ ID NO: 408327 - DNA, 615 bp, Homo sapiens
  misc_feature: GZ8MTXP02GCGXV.52.12.B01.1.454.CMB.2.raw
  modified_base (221)..(221): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctgganataagttgggaataaatattgttctggtatcagcagacgcagccacgtccctgtcgttgtcatctatacaagactacgaagaggcgcgtacgaggtactcccgtgacgcgtattctacgtcggtcctacctacgtcgtacgggacacgacgcctactctacgaaccacgtacgaacgggcccggaacccagtaccctcggtaggagtcggacggacttaggtaaaccttacgtttaacgtcgtacgggtagggtaccgggtagggacacggacgtacggaccggggtagggggttcgtacgggggacgggtaacggaacgaacggtccgtacggtaacccgttccggaagtccgaccggaccgacggtccgtccccgtcccggttacggtaccc

SEQ ID NO: 408328 - DNA, 662 bp, Homo sapiens
  misc_feature: GZ8MTXP02FU31B.52.12.B01.1.454.CMB.2.raw
  modified_base (232)..(232): a, c, t, g, unknown or other
  modified_base (526)..(526): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttcgacccagtctctactccttctgtctgcatctgtagganacagatcaccatcacgttcggccggcagtcgagggctaattacgctagtttacttacgccgttaggtactacgaacgaaaccgaaaaaccggacgggaaaacctccccgtaaaggtcctaccgtagtaacttacgtaaggtcggtacgacctaagttacctaacgtttcggacggttaaggggtccgggtacccagtacgtaacgttcgaacggcggacgtaggtacggtacgtcggtaacggaactaagttaactcctaacttaccacaaactaactacgaacgcgacgtccncgacgtacgtaccgtaggtaacttcgtttacaacttaacttacgtactactacctaaacttacgttaaacttcgtttaccttaccgttacttaccgttccgaccgtaaggaacctaaggtacaactacgtaaaccg

SEQ ID NO: 408329 - DNA, 666 bp, Homo sapiens
  misc_feature: GZ8MTXP02FY0VU.52.12.B01.1.454.CMB.2.raw
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttcctgtctgcatctgtagagacagagtcaccatcacttgccggccagtcagggcattagctagttatttagcctggtatcagacaaaaaccgaggaaacgcccctaaagcctacctgatctagtggtcgcatacaaactttgacgtaagggtcgggggtaccctaacgtacgtaacgtcgacggccgagtagtaggtactacgggtacggaacgtaagtaacttacaacttacctaacaaacgtaactacgaacgacgaacgtccgtcgaaccgaccgtaaccgtaaggtaaagttcgttaactaccttaaaactttaacgttacgttaactacctaaaaaccgtttaactttaaaacgttaacctttacctttacccgttaccgttaccgttaaccccggtacccggtaacggtaaaaccgtaacggttaaccggaacctaaccgtaaaaacccg

SEQ ID NO: 408330 - DNA, 615 bp, Homo sapiens
  misc_feature: GZ8MTXP02HR8EX.52.12.B01.1.454.CMB.2.raw
  modified_base (214)..(214): a, c, t, g, unknown or other
  modified_base (222)..(222): a, c, t, g, unknown or other
  modified_base (238)..(238): a, c, t, g, unknown or other
  modified_base (248)..(248): a, c, t, g, unknown or other
  modified_base (300)..(300): a, c, t, g, unknown or other
  modified_base (449)..(449): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtcgtccgtcgtcccaggacagacagccagcactcactnctctgganataagttgggataatntgttctgtancagcagaacgcaggccacgtcccctgcgttggcatctatcaagataccaagngacgctcgaggtactcccgtagacgtacgtattctcgtacgcccttacacgtcggtacgggaccacacgtccactcgacacaacgtcgacgaccgggaccacggtacttcgaggtagtcgacggtactcggtaactttactttacgggngtacggaggtcgggaacggacgaggaccggagggtccggggtacggggttcgggtaccggggacgggtaccggaaccgtacggtaccgtacccggtaccgttaccggtacggtaaccgaccggacccggtaccggtccccgtaccccggtaccccgttaccgtccc

SEQ ID NO: 408331 - DNA, 629 bp, Homo sapiens
  misc_feature: GZ8MTXP02GZD8D.52.12.B01.1.454.CMB.2.raw
  modified_base (231)..(231): a, c, t, g, unknown or other
  modified_base (302)..(302): a, c, t, g, unknown or other
  modified_base (310)..(310): a, c, t, g, unknown or other
  modified_base (322)..(322): a, c, t, g, unknown or other
tcagcgcagtacgacacgaccggtgctcgatttagtagtgtagattccgcgggcacgaccggtgctcgatttagtagtgtagatttgggtttgggggagtcccagtcaggacacagcatggacatgagggtccccgctcagctcctggggctcctgctgctctggctcccaggtgccagatgtgacatccagttgacccagtctccatccttctgtctgcatctgtagganacagagtcaccatcacttgccggcagtcagggcatagctagttattacgctggtatcagaacaaaaaccgngggaaacnccctaagcctcngtactctagtggtcactatactaactttgacgtaagggtcggggtcccaagtcgtaagttcaggcggtacgagtgactcgtagggacagtacttcgactctacacaactcgactacgacgaccgttacgaccgacgtaccgtagtaaggtttactttaacggaactttaaactttaacttaaccgttacggtaaacctaaacttaaacctttaaatttaccgttaaccttcctttaaccgttacctttaacccgggcccgttaacgggaaacccgttaaaggtcggtaaaacctagtttaaaacccg

SEQ ID NO: 408332 - DNA, 527 bp, Homo sapiens
  misc_feature: GZ8MTXP02I9OO8.52.12.B01.1.454.CMB.2.raw
  modified_base (249)..(249): a, c, t, g, unknown or other
  modified_base (395)..(395): a, c, t, g, unknown or other
  modified_base (462)..(462): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataatggggataaatatgttctggtatnagcagagccaggccagtcccctgcgttggtcatctatcaagataccaagagcgctcgagggactccgtgacgcgattctctggcctccactcgtcggggacacgacgccactctacgaccatcgacggccggaacccagacctcgnggatgagtctagtactattactgtcgacggcgtagggacaggcgaggcggtacgggggtcgtcgggngggacgggacaaggcgtcgaccgtcgtaggtcgacgacccgaaggccgtccgccccgtcgtaccg

SEQ ID NO: 408333 - DNA, 676 bp, Homo sapiens
  misc_feature: GZ8MTXP02IWDV8.52.12.B01.1.454.CMB.2.raw
  modified_base (136)..(136): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgntcagctcctggggctcctgctgctctggctcccaggtgccagatgtgacatccagttgacccagtctccatccttctgtctgcatctgtaggagacagagtcaccatcacttcggccggccagtcgagggctattagctagttattagccgtggtatcgaagaacaaaaaaccgaggtaaaaccgccccgtaaaagtcctaccgtagatacctagtggaccgtacacgtactaacgttgacggtaacgggttcggggtaccctaagtaccgtaaggttccgaaggcggtacgtaaggtgacgttacgacgggtaactaagtaacgttcctactaccctagaactaaatcgacggacaacggtcctacgaccgacgtaccgtaaggtaagtttactttacgaactttaacttacgtttaacgtactaaactaaaccttaaacttaaactttacgttaaccctactttacccgtaaccgtttaacccggaaccgtttaacggggaaacctaaacgggttacgaaaaccgttactaaaacccg

SEQ ID NO: 408334 - DNA, 737 bp, Homo sapiens
  misc_feature: GZ8MTXP02GPM8L.52.12.B01.1.454.CMB.2.raw
  modified_base (234)..(234): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttcgacccagtcctccattccttcctgtctgcatctgtagganacagagtcacatcacttcggccggccagtcgagggctattagctagtttattacgccttaggtactacgaacgaaccaaaaaaccggaggggaaaacctaccccgtaaagcccttaccgtaggtaacttacgtaagttcggggtacactaacttaccgtaaaacgtttggaaccggttaaacggggttccgggggtacccctaaggttaaccgtaaacggggtttccgaacgggtcgggaaccgttaggggtaggtaacgtacggtaacgggggaactaaacggtaaacttcctaaccgttcctaacgaactaacgtacacgtacgaccgtccgtcgacgtacgtccgtaagtaacgtttctttacgaacttaaatttactaacgtacttaaaccgtaaacttaccgtttaaacgttactttacccttaccgttaccttaccgttaacccggtaccgttaacgggtaaaccctaaacggtacgtaaccgtaactaaaacccgg

SEQ ID NO: 408335 - DNA, 640 bp, Homo sapiens
  misc_feature: GZ8MTXP02HFE0Y.52.12.B01.1.454.CMB.2.raw
  modified_base (221)..(221): a, c, t, g, unknown or other
  modified_base (435)..(435): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctgganataaagttggggataaatatgttctgtatcagcagagccaggccagtccccctgcgtttggtcattctaatcaaagtactaaccgaaggacggcgtactcgaacggggtactcccgtagacgtcgatttcctcgtacggcctacctacgtccgttagggggaaccacgtacgacccgactcctacgaccactccgacggaccggacccagtacncgtaggatagggagacgtacgaactttacgttaccgtaggtccggaacgggtcggtaggggacacggacggacggacgggtacgggggttcggttacgggggacggggtaacggggaaccgaaacggggccgtacggtaacccgttcgttaaacggcgaacggaccccgtaacggaccgtcccggtacccccgtacgttaccccg

SEQ ID NO: 408336 - DNA, 712 bp, Homo sapiens
  misc_feature: GZ8MTXP02F2O0O.52.12.B01.1.454.CMB.2.raw
  modified_base (231)..(231): a, c, t, g, unknown or other
  modified_base (491)..(491): a, c, t, g, unknown or other
tcagcgcagtacgacacgaccggtgctcgatttagtagtgtagattccgcgggcacgaccggtgctcgatttagtagtgtagatttgggtttggggagtcccagtcaggacacagcatggacatgagggtccccgctcagctcctggggctcctgctgctctggctcccaggtgccagatgtgacatccagttcgaccagtctccatccttctgtctgcatcgtgtagganacagacgtacacctatcacttcggccggtcagtcgagggcattagctagttattagctgtatacgagtaacaaaaaccgaggtaacacccctaaagccttaccgtagtacttacgtaagttcgggtacacctaagtactaaacgtttggacgttaaacggggttccgggtaccctaaggttacgaaacgggtttcgaacggtcggtcgtaagtggtacgtacgtagggactaagtactcaactactacaactactacganaccgtacgccttaggaccgtagtacctaggtaaggtttacttttaacgaactttaacctttaacgtttaacccgtaacgtttaaccttaaaaccttaaacgttttaaaacttaacccggttttacctttaaccctttaccgtttaaacccggtttaacccggtacccggtttaaacggggaaacccgttaaaggtaaccggtaactaaaccgttaaaaccg

SEQ ID NO: 408337 - DNA, 595 bp, Homo sapiens
  misc_feature: GZ8MTXP02HQFYM.52.12.B01.1.454.CMB.2.raw
  modified_base (253)..(253): a, c, t, g, unknown or other
  modified_base (289)..(289): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtcgtccccaggacagacagccagcatcacctgctctggagataaagtgggataatattgttctgtatcagnagagccaggccacgtcccctgtcgttggtcatctanacaagataccgaagacggcgctacgaggactcccgtgacgcgtacttctccgtcggtcctactacgtcggtagggaccacgacgccactcacgaccactcgacggccggaacccagtacctgtacggagtcgaacggtctacggtaacttacgtttacgtgtaccgagggcggtagggacgacggcgtacgggcgggtaacgggggtcggttaccgggggacgggacgggacgaacgtcggtacccggacgtccgtacggtaaccgacgacccggtacggccgttcccggccccgtaggtaccccg

SEQ ID NO: 408338 - DNA, 743 bp, Homo sapiens
  misc_feature: GZ8MTXP02GA2MQ.52.12.B01.1.454.CMB.2.raw
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataaagttggggataaatatgttcctggtatcagcagagcaggcacgtccctgcgtgtcatctactcaagtataccgaaagaggcgcgtcgacggactcccgtggaaccgcgtacgtttctacgtcgggacctaccctacgtccgttacggggaaccgaacgtacgacccgtactacgttaccgaaaccctaacgtcgaaccgggcccggggaaacccctagtacccggtcgttaacgggacgttaggaccggtaccgttaggtaaccttaaaccgtttcgtaccgggttacgaacggggttacccggggtaggaaccgtacgggtaacccgggtaggggtacccgggggtaccggggggtttcgggtaccggggggaaacccgggaaccggggtaaacccggtaaacggtccccgggttaaccggttaaccccggttaccggttaacgggaacccgtaacccggtacccggtaacccgggtaccccgttcccccgggtacccccggtttacggtacccccg

SEQ ID NO: 408339 - DNA, 584 bp, Homo sapiens
  misc_feature: GZ8MTXP02FNI11.52.12.B01.1.454.CMB.2.raw
  modified_base (438)..(438): a, c, t, g, unknown or other
  modified_base (453)..(453): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagcccaccctcagtgtccgtcgtccccaggacagacagccagcatcacctgctcgtggaagtaataaaggttggggaataaattagttgttcgtaggtatcgagacagagccaggccacgtcccctgcgttgtcactctactacaagaactaaccgaaggacgcgactacggacggactcccgtagacgtacgtacttacgtcgtcggcctaccgtacgtcgtacgggacacacgccactcacgacagcacggccggaaccagcctcgaggtanagcgtatagaacttntacgtgaccgagggtccgagggacacgcgacggtacgggtacgggggtcgtacggggacggacggacgtaacgcgtaccgtacgtacgtaggaaccgacgaccgtacggtccgtccgccccgtcggtaccc

SEQ ID NO: 408340 - DNA, 618 bp, Homo sapiens
  misc_feature: GZ8MTXP02F31KI.52.12.B01.1.454.CMB.2.raw
  modified_base (252)..(253): a, c, t, g, unknown or other
  modified_base (288)..(288): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataaagtggggataaatatgttctggtatcnncagaagcagccacgtcccctgcgttggtcatctanacaagactaccaagaggcgctcgaggggactcccgtgacgcgtattctctcggcctaccactcgtacggggacacgtacgccactctacgacctatcaggacccggaccaacgacttcgaggataggaggacctagaacgttaatttacgtggttacgagggtcgggttacgggaacgacggaccggaacggtccggggtaacggggggttcggttaccggggacgggggaaacggggaccgaaacggccgtaccggtaaacccggttccgtaacgggtccgaaccgacccggaaacggtcccgtacccggcccccgttccggtaacccg

SEQ ID NO: 408341 - DNA, 887 bp, Homo sapiens
  misc_feature: GZ8MTXP02FWLSH.52.12.B01.1.454.CMB.2.raw
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcacgcccaccctcagtcgtccgtcgtccccaggacagacacgccagcatccacctgctctgggaagtaagtaaaggttagggggtaattaaaattagttcgtttccgtaggtatacgagcgaagaacgccgacggcctaccggtccccgtgtcggtttggtactacttctaatacaaagtacgtaaccgaagacggtccgacgtacggacggggtactcccgtaggtaccgtacgtacgtttccgtcgttccggtacccttaacccgtaccggttccgggtaacgggggaaccaaccgaccggtacctaaccgttcctaaccggaaccctacgttacccgggaacgggacccccggggaacccgtaacggtacccgttacgggtaagggtagttaccggggaacgggttaccttaaccggtaaaccgttttaacgtttaccgggtacgggttacccgggtaaggggtaccccgggttaagggggaccccgaagggtacccggtacgggggttacccgggggttaaaccgggggggtttcggttaaacccgggggacgggggttaaaccccggaaaccggtaaaccgggggttcccgtaccccgggggttaaacccccggttacggggttaaaacccggtcccgggtaaaacccgggaacccccgggttaccgggtcccccgttaacccccggggtcccccccggtttaacggtttaaccccccg

SEQ ID NO: 408342 - DNA, 646 bp, Homo sapiens
  misc_feature: GZ8MTXP02H3YKR.52.12.B01.1.454.CMB.2.raw
  modified_base (292)..(292): a, c, t, g, unknown or other
  modified_base (306)..(306): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtcgtcccaggacagacagccagcactcacctgctcgtaggaagtaattaaaggttggggtaattaaatagttcgtttcgtaggtatcagcagacgccagccacgtccccngtcgttgcatctanacaagataacgaaggagcgactcgaacggctccgtgacgcgtacttcgtcgtcggtcctactacgtcggtacgggaccaacgacgtacccacgttaccgtacgaaccgtacgtaccggacggacccgggaacccgtaacgtaaccgtcgtagggaacgttcgggacgtccgtaagttaacttaacgtttcgacggttacgacgggtaccggtacggacgtacggaccgaggaccggggtacgggggttcgtccggggacgggtaaaccgggacctaaggccgtacgacccgttacggtacgaaccgacgaaccgtcggccgtccccgaccgttcggaccc

SEQ ID NO: 408343 - DNA, 556 bp, Homo sapiens
  misc_feature: GZ8MTXP02FTFXF.52.12.B01.1.454.CMB.2.raw
  modified_base (214)..(214): a, c, t, g, unknown or other
  modified_base (218)..(218): a, c, t, g, unknown or other
  modified_base (222)..(222): a, c, t, g, unknown or other
  modified_base (238)..(238): a, c, t, g, unknown or other
  modified_base (294)..(294): a, c, t, g, unknown or other
  modified_base (383)..(383): a, c, t, g, unknown or other
  modified_base (416)..(416): a, c, t, g, unknown or other
  modified_base (461)..(461): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcagtgtccgtcgtccccaggacagacagccagcatcacctnctcngganataagtgggataaatntgttcctgtatcagcagaagcaggccacgtcccctgtcgttggtcatctatacaanactaaccgaaggaggcgactcgacggctacccgtgacgcgtacttctacgtcgacctaccactcgtacgggaccacgacgccacgtacncgaccacgtcgaacgcccgggaaccagccttgnggataggcgacttagaccgttatacctgtacgaggtccgaggganacgcgaggacggtcggggtcggtacgggacggacggacgacggtcgtacgaccgtcgtacgcgtaccgaccgtacgccgtccgcccgtgtacccg

SEQ ID NO: 408344 - DNA, 578 bp, Homo sapiens
  misc_feature: GZ8MTXP02FLU80.52.12.B01.1.454.CMB.2.raw
  modified_base (221)..(221): a, c, t, g, unknown or other
  modified_base (250)..(250): a, c, t, g, unknown or other
  modified_base (258)..(258): a, c, t, g, unknown or other
  modified_base (421)..(421): a, c, t, g, unknown or other
tcagcgcagtacgacacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagccaccctcaggtgtccgtcgtcccaggacagacagccagcatcacctgctctganataaagtgggaataatatgttctggtatnagcagacncgaggccacgtcccctgcgttggtcatctatacaagataccgaagacggcgctcgagggactcccgtgaccgcgacttctcgtggcctacctacgtcggtcggggaacacgacgacctactcgtacgacctactaccgaacggaccgggacccacgacttcgnggtaacgagacgtactagtacttagttacgtgtacggacggcggaggacgacgacggagggtcggggtcggggtacggtcggggacgggacggacgacggaccgtaccgaccgtacgtacgtaacgacgaccgtacgccgtcccgtcccgtcgtacc

SEQ ID NO: 408345 - DNA, 506 bp, Homo sapiens
  misc_feature: GZ8MTXP01EPQDB.11.11.A11.1.454.CMB.2.raw
  modified_base (341)..(341): a, c, t, g, unknown or other
  modified_base (356)..(356): a, c, t, g, unknown or other
  modified_base (425)..(425): a, c, t, g, unknown or other
  modified_base (458)..(458): a, c, t, g, unknown or other
  modified_base (485)..(485): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaaacgataaggacttatttagcttggtatcagacaaaaaccaggacagcctcctaaactgctcatctcctgggcatctacccgggcacccggagtccctgaccgattcagtggcacgcgggtntgggacagaacttcnctctcaccatcagcaacctgcaggctagaagatgtggctagtttatactgtcagcagttattgtagaanctccgcttcacgtttcgggcggtagggacccgngggtggagattcgagacgaacgttggnggctgcaccattctgttcttc

SEQ ID NO: 408346 - DNA, 530 bp, Homo sapiens
  misc_feature: GZ8MTXP01BWERR.11.11.A11.1.454.CMB.2.raw
  modified_base (344)..(344): a, c, t, g, unknown or other
  modified_base (395)..(395): a, c, t, g, unknown or other
  modified_base (512)..(512): a, c, t, g, unknown or other
  modified_base (519)..(519): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttctttatatagtgtacaaagataaggacttattagcttggatcagacaaaaaccaggacagcctacctaaactgctcatctcctgggcatccgtaccccgggcaccccggagtcccctgaccgattcaggtggcaggccgggtntgggacagaacttcaatctacaccatcacgacaaccctgcaggctagaagntagtggactagtttacttactgttacgagcgtaagttagttgtagaacgccgtccgcttactacgtttccgggacgggtagggaccgcgggtaggagattcgagacgacgttgttgntgcaccnttctgttcttc

SEQ ID NO: 408347 - DNA, 499 bp, Homo sapiens
  misc_feature: GZ8MTXP01DOTUY.11.11.A11.1.454.CMB.2.raw
  modified_base (252)..(252): a, c, t, g, unknown or other
  modified_base (352)..(352): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactctttatatagtgtcaacgataaggactattagcttggatcagcaaaaaccnggacagcctcctaaactgctcatctcctgggcatcctaccccgggcaccccggagtcccctgaccgattcagtggcagcgggtctgggacagaaccttcnctctcaccatcagcaaaccctgcagggctgaagatgtggctagtttatactgtcagcagtattgtgaagctccgctcactttcgggcggtagggaccgcgggtggagattcgagcgaacgttggttggctgcaccattctgttcttc

SEQ ID NO: 408348 - DNA, 531 bp, Homo sapiens
  misc_feature: GZ8MTXP01D1OGM.11.11.A11.1.454.CMB.2.raw
  modified_base (340)..(340): a, c, t, g, unknown or other
  modified_base (355)..(355): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaaacgataaggacttattagcttggtatcagacaaaaaccaggacagcctacctaaactgctcatctcctgggcatcctaccccgggcacccggatccctgaccgattcagtgcagcgggtntgggacagaacttcnctctcaccatcagcaacctgcagctagaagatgtgactagtttattactgtacagctaagtattgtagaacgtcctccgcttacgtacgtttcggggacgggacggggaccgcggggttgggacgtattcgaaggaacgaacgttggttaggcctagccaccattctcgttcttcc

SEQ ID NO: 408349 - DNA, 532 bp, Homo sapiens
  misc_feature: GZ8MTXP01BDV4J.11.11.A11.1.454.CMB.2.raw
  modified_base (208)..(208): a, c, t, g, unknown or other
  modified_base (353)..(353): a, c, t, g, unknown or other
  modified_base (425)..(425): a, c, t, g, unknown or other
  modified_base (467)..(467): a, c, t, g, unknown or other
  modified_base (515)..(515): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttanatagtgtacaaacgataaggacttatttagcttggtatcagacaaaaaccaggacagcctactaaactgctcatctcctgggcatcctacccggcacccggagtccctgaccgattcagtggcagcggtctgggacagaacttcnctctacaccatcagcaacctgcaggctagaagatgtaggctaagtttatactgttaagctagtattcggtanaagtctccgcttcgtaacgtttcggcgggtagggacccgggngggtaagagacgtacgaaggtacgtaagttgttcggctgacctaactnttcttcgttcttcgtaa

SEQ ID NO: 408350 - DNA, 565 bp, Homo sapiens
  misc_feature: GZ8MTXP01ESKTO.11.11.A11.1.454.CMB.2.raw
  modified_base (364)..(364): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaaacgataaggacttatttagcttggtatcagacaaaaaccaggacagcctacctaaactgctcatctccgtgggcatccgtaccccgggcaccccggacgtcccctgaccgattcagtggcacggcgggtctgggacagacttcnctctcaccatcacgcaacctgcaggctagaagtagtggtggtactagttttacttacgtgttacagtcgtaagttagttggtagaacgtccgtccgcttaccgtacgtttccggggacgggtacggggacccggtgggtaggagtacgttcgaaggacgaacgttggttacgggctggccactattcgttcgttctttaac

SEQ ID NO: 408351 - DNA, 533 bp, Homo sapiens
  misc_feature: GZ8MTXP01DJ77N.11.11.A11.1.454.CMB.2.raw
  modified_base (410)..(410): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagactcttttatatagtgtcaaacgataaggactatttagcttggtatcagacaaaaaccaggacagcctacctaaactgctcatctcctgggcatccgtaccccgggcaccccggagtcccctgaccgattcagtggcacggcgggtctgggacagtaacttcaactctcaccatcagcaacctgcaggctagaagatgtgctagtttattacngtacagcagttattgtagaagcctccgctaccgtacgtttcgggcgggtacgggaccgcgggtggagtattcgaaggacgaacgttggttacggctgccaccctagttcttcgttcctttccg

SEQ ID NO: 408352 - DNA, 516 bp, Homo sapiens
  misc_feature: GZ8MTXP01AH2FH.11.11.A11.1.454.CMB.2.raw
  modified_base (352)..(352): a, c, t, g, unknown or other
  modified_base (423)..(423): a, c, t, g, unknown or other
  modified_base (457)..(457): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagaggccaccatcgagtgcaagtccagcgagactcttttatatagtgtcaacgataaggactatttagcttggtatcagacaaaaccaggacagcctcctaaactgctcatctcctgggcatctaccccgggcaccccggagtccctgaccgattcagtggcacgcgggtctgggacagaacttcnctctcaccatcagcaaaccctgcaggctagaagatgtggctagtttattactgtcagctagtattgtgaanctccgctcgacgtttcgggcggtacgggacccgngggtggagattcgaggacgaacgttggttcgggctggccaccgtattcctgttctttcc

SEQ ID NO: 408353 - DNA, 525 bp, Homo sapiens
  misc_feature: GZ8MTXP01DBHHX.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagactctttatatagtgtcaacgataaggactatttagcttggtatcagacaaaaaccaggacagcctacctaaactgctcatctcctgggcatcctacccgggcacccggagtccctgaccgattcagtggcacggcgggtctgggacagaacttcaactctcaccatcagcaacctgcaggctgaagtatgtggctagtttattactgtacagcgtaagttattagtgaacgtcctccgtcttcgtacgtttccgggcgggacgggcccggcgggtggagacttcgaaggacaacgttggttacggctgccacattctcgttcgttcc

SEQ ID NO: 408354 - DNA, 533 bp, Homo sapiens
  misc_feature: GZ8MTXP01AO5AB.11.11.A11.1.454.CMB.2.raw
  modified_base (314)..(314): a, c, t, g, unknown or other
  modified_base (358)..(358): a, c, t, g, unknown or other
  modified_base (366)..(366): a, c, t, g, unknown or other
  modified_base (388)..(388): a, c, t, g, unknown or other
  modified_base (391)..(391): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagagggccaccatcgagtgcaagtccagcgagacttcttttatatagtgtacaaacgataaggacttatttagcttggtatcagacaaaaaccaggacagcctacctaaactgctcatctcctgggcatccgtacccgggcacccggngtccctgaccgtattcagtggcaggcggtctgggacagacttcnctctcacntcagcaactgcaggctagaagntgngtactagtttatactgtcagcgtagttattgagaagtcctccgtctcgtacgtttccgggcggtacgggccgcgggtggagtacgttcgaggacgaacgttggttcggctcggcctacccgtattccgtgttcctttaaccg

SEQ ID NO: 408355 - DNA, 577 bp, Homo sapiens
  misc_feature: GZ8MTXP01BIWYZ.11.11.A11.1.454.CMB.2.raw
  modified_base (208)..(208): a, c, t, g, unknown or other
  modified_base (349)..(349): a, c, t, g, unknown or other
  modified_base (378)..(378): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttanatagtgtcaaacgataaggactattagcttggtatcagacaaaaaccaggacagcctacctaaactgctcatctcctgggcatcctacccggcacccggatccctgaccgattcagtgcagcgggtctgggacagacttcnctctcacatcagcaactgcaggctgaagntagtggctagtttatactgtcagcgagttattgtagtaacgtcctccgcttaccgtacgttttcggggacgggtaacggggaccccggtcggggttagggaacgtacgttaccggaaaggtaacccggttaaacgttgggttacggggccttaggaacccgtaaccccgtatttcccgttcggtttcccgtttaacccg

SEQ ID NO: 408356 - DNA, 553 bp, Homo sapiens
  misc_feature: GZ8MTXP01B4WJE.11.11.A11.1.454.CMB.2.raw
  modified_base (406)..(406): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaaacgataaggactatttagcttggtatcagacaaaaaccaggacagcctacctaaactgctcatctcctgggcatctaccccggcacccggacgtccctgaccgattcagtggcaggcgggtctgggacagaacttcaactctcacatcagcaaccctgcaggctgaagatcgtggctagtttatacngtcagcagttattgtagaagtcctccgctcgtacgtttcggggacggtacggggacccggcgggtgggagtacgttacgaacggtacgttaaacgttgggttcggtcctcggccctaacccgttacgttccgttcgttccgttaacg

SEQ ID NO: 408357 - DNA, 542 bp, Homo sapiens
  misc_feature: GZ8MTXP01DJ2WK.11.11.A11.1.454.CMB.2.raw
  modified_base (355)..(355): a, c, t, g, unknown or other
  modified_base (435)..(435): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttatatagtgtcaaacgataaggactatttagcttggtatcagacaaaaaccaggacagcctcctaaactgctcatctcctgggcatcctacccgggcaccccggagtcccctgaccgattcagtgcaggcggtctgggacagaaccttcnctctcaccatcagcaacctgcaggctagaagatgtggctagtttattactgtcagctagttattgtagaagtcctccgtntctacgtttcgggcggtacgggacccgtgggtaggagtacgttcgaaggtacgttaaaccgttgggttcgggcgttaggccaacccgttattccgttcgttccttcg

SEQ ID NO: 408358 - DNA, 563 bp, Homo sapiens
  misc_feature: GZ8MTXP01B23GK.11.11.A11.1.454.CMB.2.raw
  modified_base (357)..(357): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaaacgataaggacttatttagcttggtatcagacaaaaaccaggacagcctactaaactgctcatctcctgggcatcctaccccggcacccggatccctgaccgattcagtggcacggcgggtctggggacagaacttcnctctcaccatcagcaaacctgcaggctagaagatggtggactagtttatactgtacagcgtaagttagttgtagaacgtcctaccggcttacgtaccgtttccggggacgggtacggggccggtcgggtggaggtattacgaacggtaacggttaacgttggttcggaacgtcgaacctaccctagttccgtcgtttccgttaacc

SEQ ID NO: 408359 - DNA, 511 bp, Homo sapiens
  misc_feature: GZ8MTXP01CPYJK.11.11.A11.1.454.CMB.2.raw
  modified_base (258)..(258): a, c, t, g, unknown or other
  modified_base (355)..(355): a, c, t, g, unknown or other
  modified_base (363)..(363): a, c, t, g, unknown or other
  modified_base (429)..(429): a, c, t, g, unknown or other
tcagcgagagataccacgaccggtgctcgatttagctacgactgcagggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaaacgataaggactatttagcttggtatcagacaaaaaccnggacagcctacctaaactgctcatctcctgggcatcctacccgggcacccggagtccctgaccgattcagtggcacgcgggtctgggacagacttcnctctcacntcagcaacctgcaggctagaagatgtgctagtttatactgtacagctagttattgagagtctccgntccgtacgtttcgggcggtacgggccgcgggtggagtattcgaaagcgaacgttgacgggctgccacattctcgttcttaac

SEQ ID NO: 408360 - DNA, 553 bp, Homo sapiens
  misc_feature: GZ8MTXP01DMMZ5.11.11.A11.1.454.CMB.2.raw
  modified_base (255)..(255): a, c, t, g, unknown or other
  modified_base (344)..(344): a, c, t, g, unknown or other
  modified_base (351)..(351): a, c, t, g, unknown or other
  modified_base (360)..(360): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttctttatatagtgtacaacgataaggactattagcttggtatcagcaaaaaccnggacagcctcctaaactgctcatctcctgggcatccgtaccccggcacccggagtcccctgaccgattcagtgcagcgggtctgggacngacttcnctctcaccntcagcaactgcagctgaagataggtggactagtttatactggtacagcgtaagttattgtagaacgtcctaaacccgtcttacgtaccgtttcggggacggacggggccggtcgggtggagtagttacgaacgaacgttaaacgttggttacggcttaggcctaacccgtagttccttcgttccgttttcccg

SEQ ID NO: 408361 - DNA, 658 bp, Homo sapiens
  misc_feature: GZ8MTXP01EVLJR.11.11.A11.1.454.CMB.2.raw
  modified_base (254)..(254): a, c, t, g, unknown or other
  modified_base (258)..(258): a, c, t, g, unknown or other
  modified_base (641)..(658): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactctttatatagtgtacaacgataaggacttattagcttggatcagacaaaaccngacngcctctaactgcctcactcctcgtcgtaccgtacgtaccccggccgacccgtacgtaccgtcgtacgtacgtcgtacggtacgggtcgacggtaccgggtaccggttacggtacgtacctaccgttaaccctaccctaacccgtaccgtaacccgtaccgtacccggtaaccgtacccggtaaccccggttaaccgggtacgggttaaccgggttaaacccgggtttagggttaaacgggtttaacgggtttaacgggttttaaccgggtttttaaccggttttaaacccgggtttttaaaccgtttaaccgggttacggtttaaacccgggttaaccgggtttaaaccgggtttaaccggggggtttttaaaccggggtttnnnnnnnnnnnnnnnnnn

SEQ ID NO: 408362 - DNA, 521 bp, Homo sapiens
  misc_feature: GZ8MTXP01DOQUR.11.11.A11.1.454.CMB.2.raw
  modified_base (255)..(255): a, c, t, g, unknown or other
  modified_base (338)..(338): a, c, t, g, unknown or other
  modified_base (353)..(353): a, c, t, g, unknown or other
  modified_base (458)..(458): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttatatagtgtcaaacgataaggactattagcttggatcagacaaaaaccnggacagcctacctaaactgctcatctcctgggcatcctaccccgggcaccccggatccctgaccgattcagtgcaggcgggtntgggacagaacttcnctctcaccatcagcaaacctgcaggctgaagatgtggactagtttatacgtgtacagctagtattgtgaagctccgctctacgtttcgggcggagggacccgggngggtggagtagcgaacgacgttaacgttggttacggctcgaactacctattcttcgttccttc

SEQ ID NO: 408363 - DNA, 515 bp, Homo sapiens
  misc_feature: GZ8MTXP01D0K2Q.11.11.A11.1.454.CMB.2.raw
  modified_base (351)..(351): a, c, t, g, unknown or other
  modified_base (386)..(386): a, c, t, g, unknown or other
  modified_base (464)..(464): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaacgataaggactatttagcttggtatcagacaaaaaaccaggacagcctacctaaactgctcatctcctgggcatctacccggcaccggatccctgaccgattcagtgcagcgggtctgggacagaacttcnctctcaccatcagcaacctgcaggctagaagatgnggtctagtttatactgtacagtcaagttattgtagaacgtcctccgtctctacggtttcgggacggtagggacccggngggtgaggattcgagacgaacgttgttggctgcaccattcgtcgttcttcc

SEQ ID NO: 408364 - DNA, 530 bp, Homo sapiens
  misc_feature: GZ8MTXP01EQ4IK.11.11.A11.1.454.CMB.2.raw
  modified_base (207)..(207): a, c, t, g, unknown or other
  modified_base (336)..(336): a, c, t, g, unknown or other
  modified_base (466)..(466): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagactcttttanatagtgtacaacgataaggactatttagcttggtatcagacaaaaaccaggacagcctacctaaactgctcatctcctgggcatctacccggcacccggatccctgaccgattcagtggcacgcgggtntgggacagaacttcaactctacaccatcagcaaacctgacgaggctagaagatgtggctagtttatactgtacagcgagttattgtagaacgctccgctactacgtttcgggacggacggggacccgggnggtaggagtattacgaacgtaacgacgttggttcggctacgaaccactattcgttcgttcctcg

SEQ ID NO: 408365 - DNA, 556 bp, Homo sapiens
  misc_feature: GZ8MTXP01AJOXR.11.11.A11.1.454.CMB.2.raw
  modified_base (367)..(367): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagagggccaccatcgagtgcaagtccagcgagacttcttttatatagtgtacaaacgataaggtacttatttagcttggtatcagacaaaacaggacagcctactaaactgctcatctccgtgggcatccgtaccccgggcaccccgggatcccctagaccgtattcgaggtcggcacggcgggtctgggacagaacttcnctctcacatcagcaacctgcaggctagaagagtcggtagctaagtttatactgtacagctagttattgtagaacgtcctcgcttacgtacgtttcgggacggacgggcccggtgggtggagtacgttacgaaggaacgttacgttggcgggtaactcggcctaacctgttcgttcgttccgtttaaccg

SEQ ID NO: 408366 - DNA, 560 bp, Homo sapiens
  misc_feature: GZ8MTXP01AEVRH.11.11.A11.1.454.CMB.2.raw
  modified_base (350)..(350): a, c, t, g, unknown or other
  modified_base (383)..(383): a, c, t, g, unknown or other
  modified_base (408)..(408): a, c, t, g, unknown or other
  modified_base (423)..(423): a, c, t, g, unknown or other
  modified_base (472)..(472): a, c, t, g, unknown or other
tcagcgagagataccacgaccggtgctcgatttagctacgactgcagggcagcaagatggtgttgcagacccaggtcttcatttctctgttgctctggatctctggtgcctgtgggacatcctgatgacccagtccccagatatcctgcctgtgtctctggcgagaggccaccatcgagtgcaagtccagcgagactcttttatatagtgtacaacgataaggactattagcttggtatcagacaaaaccaggacagcctacctaaactgctcatctccgtggcatccgtacccggcacccggatccctgaccgtattcagtggcacggcgggtctgggacagaacttcnctctcaccatcagcaacctgcaggctagaagtntgtggctagtttatacgtgtacagngtagtagttgagaanctccgctctacgttcggacgggtacgggcccggaaggtggaaaggtacnccggtaaaggaacccggttaaaccgttgggttacgggtccgtggtccccgaaaccctagttacccggtttcgttccgttttaaccccg

SEQ ID NO: 408367 - DNA, 501 bp, Homo sapiens
  misc_feature: GZ8MTXP01AXOET.11.11.A11.1.454.CMB.2.raw
  modified_base (256)..(256): a, c, t, g, unknown or other
  modified_base (452)..(452): a, c, t, g, unknown or other
  modified_base (491)..(491): a, c, t, g, unknown or other
tcagcgagagataccacgaccggtgctcgatttagctacgactgcagggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttatatagtgtcaaacgataaggactatttagcttggtatcagacaaaaaccnggacagcctactaaactgctcatctcctggcatcctaccccgggcacccggagtccctgaccgattcagtgcagcgggtctgggacagaacttcaactctcaccatcagcaaccctgcaggctagaagatggtggctagtttatactgtcagctagtattgagaagcctcgctcgtacgttcgggcggagggccgnggtgagattcgaggacgacgttggttcggctgcaccgtnttctgttctc

SEQ ID NO: 408368 - DNA, 520 bp, Homo sapiens
  misc_feature: GZ8MTXP01EX4O2.11.11.A11.1.454.CMB.2.raw
  modified_base (357)..(357): a, c, t, g, unknown or other
  modified_base (393)..(393): a, c, t, g, unknown or other
  modified_base (420)..(420): a, c, t, g, unknown or other
  modified_base (435)..(435): a, c, t, g, unknown or other
  modified_base (463)..(463): a, c, t, g, unknown or other
  modified_base (509)..(509): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagaggccaccatcgagtgcaagtccagcgagactcttttatatagtgtcaaacgataaggactatttagcttggtatcagacaaaaaccaggacagcctcctaaactgctcatctcctggggcatcctaccccgggcaccccggatcccctgaccgattcagtggcacggcgggtctggggacagaacttcnctctacaccatcagcaacctgcaggctagaagatgnggctagtttattactgtcagcgagttnttgtgaagctcccgntcacgtttcgggcgggacggggacccgnggggttaggagacttcgaacggacgaacgttgttgggctgcacctnttctcgttctc

SEQ ID NO: 408369 - DNA, 584 bp, Homo sapiens
  misc_feature: GZ8MTXP01A8MN5.11.11.A11.1.454.CMB.2.raw
  modified_base (364)..(364): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgacaagtccagcgagtacttctttatatagtgtacaaacgataaggacttatttagcttaggtatcaagacaaaaaccaggacacgcctacctaaactgctcatctccgtgggccacgtccgtaccccgggcaccccggacgtcccctagaccgtattcgaggtcggcgacggcgggtntgggacagtaactcaactctcaccatcacgacaactgacgaggctagaacgatggtaggtacttagtttatacgtgtacgagactaagttagttgagtacgtccgtccgtctacgtacggttcggggacggtacggggccggtcgggtaggacgtacttacgaacggtaccgagttcggttcgaactcgaacctaccgtattcgtcgttccgtttaaccg

SEQ ID NO: 408370 - DNA, 520 bp, Homo sapiens
  misc_feature: GZ8MTXP01CMB0Y.11.11.A11.1.454.CMB.2.raw
  modified_base (343)..(343): a, c, t, g, unknown or other
  modified_base (357)..(357): a, c, t, g, unknown or other
  modified_base (459)..(459): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaaacgataaggactatttagcttggtatcagacaaaaaccaggacagcctactaaactgctcatctcctgggcatcctaccccgggcacccggagtccctgaccgattcagtggcacgcgggtcngggacagaacttcnctctcaccatcagcaacctgcaggctagaagatgtggctagtttatactgtcagcgtagttagttgagagcctccgctccgtacgttcgggcggaggcccgngggtgacggattcgaaggtacgaacgttggcggtctagccaacctgttcttcgttctttcc

SEQ ID NO: 408371 - DNA, 511 bp, Homo sapiens
  misc_feature: GZ8MTXP01DZHUO.11.11.A11.1.454.CMB.2.raw
  modified_base (352)..(352): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaaacgataaggactattagcttggtatcagacaaaaacaggacagcctacctaaactgctcatctcctgggcatcctacccgggcacccggagtccctgaccgattcagtggcacgcgggtctgggacagacttcnctctcacatcagcaactgcaggctgaagatgtggctagttatactgcagcgagtattgtgaagtcctaccgctctacgtttcgggcgggtacgggtaccggcggtggagtattcgaagacgaacgttgttaggctgccacctattcgtcgttccttaac

SEQ ID NO: 408372 - DNA, 619 bp, Homo sapiens
  misc_feature: GZ8MTXP01CABN3.11.11.A11.1.454.CMB.2.raw
  modified_base (350)..(350): a, c, t, g, unknown or other
  modified_base (392)..(392): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagactcttttatatagtgtacaaacgataaggactatttagcttggtatcagacaaaaccaggacagcctacctaaactgctcatctcctgggcatccgtaccccgggcacccggagtcccctgaccgtattcagtggcacggcggtctgggacngtaacttcaactctcaccatcagcaacctgcaggctagaagntgtggtactagtttatacgtgtacagcgtagttagttgtagtaacgtccgtcccggtcttacccgtaaccgttttccgggggaccggggtaacggggcccgggtaacggggttagggacggtaacttaccggaaacgggaaccggttaaaccgtttgggttaccggggtaaccttcgggaaccctaaccccgtacggtttacccttcggtttcccgttttaaccccg

SEQ ID NO: 408373 - DNA, 589 bp, Homo sapiens
  misc_feature: GZ8MTXP01A6ROX.11.11.A11.1.454.CMB.2.raw
  modified_base (261)..(261): a, c, t, g, unknown or other
  modified_base (317)..(317): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagtacttcttttatatagtgtacaaacgataaggtacttatttagcttggtatcagacaaaacnggacagcctactaaactgctcatctccgtgggcactccgtacccgggcaccccggntccctgaccgtattcagtggcgacggcggtcgtggggacagtaaccttcaactctaccaccatccagcaaacctgacgaggctagaagagttggtggtacttaagtttactacgttgtacagtacgtaagttagttgtagaacgtccgtccgtcgttaccgtacgtttccggggacggacggggaccggtcgggtaggacgtacgttacgaaggtaccgaacgttcggttacgggctacggcctaacccgtgttcctcgttccgtttaaccg

SEQ ID NO: 408374 - DNA, 632 bp, Homo sapiens
  misc_feature: GZ8MTXP01EHBIT.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagtacttcttttatatagtgtacaacgataaggacttattagcttggtatcagacaaaacaggacagcctactaaactgctcatctccgtgggcatccgtacccgggacaccccggactcccgtagaccgtattcagtggcacggcgggtctgggacagtaacttcaactctacaccatcagacaacctgacaggctagaaagtagttaggtcggacttaagtttattaaccgtgtacaggtactagttattagtagaacgtcctcccggtcttaccgtacggtttaccggggacggggtaaccggggtcccgggtaacggggttcgggaaaggtacttaacggaaacgggaaacggttaaaccggttgggttacggtaaccgttacggaacccgttaaaccgtactttaccggttaaccgtttccgttttaacccg

SEQ ID NO: 408375 - DNA, 542 bp, Homo sapiens
  misc_feature: GZ8MTXP01CLHMK.11.11.A11.1.454.CMB.2.raw
  modified_base (208)..(208): a, c, t, g, unknown or other
  modified_base (420)..(420): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtcaagataaggactattagcttggtatcagacaaaacaggacagcctacctaaactgctcatctccgtgggcatccgtaccccgggcacccggatcccctgaccgattcaggtcggcacggcgggtctagggacagtaaccttcaacctctccacctatccagtacaaaccctgcaagggctagaagatgtggctagtttattacngtcagcgtagttatgtagagtcctcgctcgtacgttcgggcggacgggccgtcggtaggagacttcgaagtaccggacgttggagggtcctgaaccgaccctagttccgttgttccttaacg

SEQ ID NO: 408376 - DNA, 569 bp, Homo sapiens
  misc_feature: GZ8MTXP01D7Q6V.11.11.A11.1.454.CMB.2.raw
  modified_base (276)..(276): a, c, t, g, unknown or other
  modified_base (314)..(314): a, c, t, g, unknown or other
  modified_base (353)..(353): a, c, t, g, unknown or other
  modified_base (384)..(384): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttatatagtgtcaacgataaggactattagcttgatcagacaaaaaccaggacagcctacctaaaactgctnatctcctgggcatcctaccccgggcacccggagtcccngaccgattcagtggcacgcgggtctgggacagaacttcnctctcaccatcagcaacctgcaggctgaagntgtggctagtttatactgtacagcgtaagttattagtagaacgtcctcccggacttccgtacgtttcggggccgggtacggggcccggtgggtagggacgacttcgaaacggtaacccggaaacgttgggttacggggtcccttggaaccctaaccgtacttcgttccggtttccgtttaacccg

SEQ ID NO: 408377 - DNA, 511 bp, Homo sapiens
  misc_feature: GZ8MTXP01BBZLX.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttatatagtgtcaaacgataaggactatttagcttggtatcagacaaaaaccaggacagcctacctaaactgctcatctcctgggcatcctacccgggcaccccggagtccctgaccgattcagtggcacggcgggtctgggacagaacttcaactctcaccatcagcaactgcaggctagagatgtgctagtttatactgtacagcagttattgtagaagctccgctctacgtttcgggcggtacgggccggcggtggagacttcgaagacgacgttggttacggctgcaccgattctgttccttc

SEQ ID NO: 408378 - DNA, 576 bp, Homo sapiens
  misc_feature: GZ8MTXP01B21JR.11.11.A11.1.454.CMB.2.raw
  modified_base (209)..(209): a, c, t, g, unknown or other
  modified_base (352)..(352): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagagggccaccatcgagtgcaagtccagcgagacttcttttanatagtgtacaaacgataaggacttattagcttaggtatcagacaaaaccaggacagcctactaaactgctcatcctccgtgggcatccgtaccccgggcaccccggacgtcccctgaccgtattcaggtcggcacggcgggtntgggacagtaaccttcaactctacaccatcagcaacctgcaggctagaagtagtaggtggtacttagtttactactgtcagtcgtaagttagttgtagaacgtccgtccgcttccgtacgtttcggggacgggtacgggccggtcgggtaggagtacgttcgaacggtaacgttaacgttggttcggtaactcggaaccaacccttcttccgttcgttccttcg

SEQ ID NO: 408379 - DNA, 553 bp, Homo sapiens
  misc_feature: GZ8MTXP01DF1LY.11.11.A11.1.454.CMB.2.raw
  modified_base (354)..(354): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggactatttagcttggtatcagacaaaaccaggacagcctctaaactgctcatctcctgggcatcctacccggcaccccggagtcccctgaccgattcagtggcacgcgggtctgggacagaaccttcnctctcaccatcagcaacctgcaggctgaagatgtgctagtttatactgtacagctaagttagttgagaacgtcctccgtcttaccgtacgtttcggggaccgggacggggtacccggcggggttgggaggtacgttacgaaggtaccgttaaacgttggttacgggcttaggcctaccgattcccgtgttcctttaacc

SEQ ID NO: 408380 - DNA, 643 bp, Homo sapiens
  misc_feature: GZ8MTXP01BHQW1.11.11.A11.1.454.CMB.2.raw
  modified_base (262)..(262): a, c, t, g, unknown or other
  modified_base (291)..(291): a, c, t, g, unknown or other
  modified_base (411)..(411): a, c, t, g, unknown or other
tcagcgagagataccacgaccggtgctcgatttagctacgactgcaggggcagcaagatggtgttgcagacccaggtcttcatttctctgttgctctggatctctggtgcctggtggggacatcctgatgacccagtccccagatatcctgcctgtgtctcgtgggcgagagggccaccatcgagtgcaagtccagcgagtacttctttatatagtgtacaaagataaggtacttattagcttaggtatcaagacaaaaccnggacagcctactaaactgctcatcctcgngggcacgtccgtaccccggcaccccggtacgtccctgaccgtattccgagtcggcacggcgggtactgggacacgtaacttcaacgtctaccacatcacgcaacctgcgtaggctagaanagttggtacgtacttaagtttactacgtagtacagcgtaagttagtttgacgtaacgtccgtacccgtacttaccgttaccggtttcgggggaccgggtaacgggggccccggtaacggggttaaggggaaacgtaccgttacgaaacgggtaccgttaaaccgttgggttccgggcgttaccgggaacctaaccccggtatttcccggttcgtttaacccgtttaaccccg

SEQ ID NO: 408381 - DNA, 587 bp, Homo sapiens
  misc_feature: GZ8MTXP01B18WV.11.11.A11.1.454.CMB.2.raw
  modified_base (209)..(209): a, c, t, g, unknown or other
  modified_base (366)..(366): a, c, t, g, unknown or other
  modified_base (398)..(398): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagagggccaccatcgagtgcaagtccagcgagacttcttttanatagtgtacaaacgataaggacttatttagcttggtatcagacaaaaaccaggacagcctactaaactgctcatctcctgggcatcctaccccgggcacccggacgtcccctagaccgtattcaggtcggcacggcgggtctgggacagaaccttcnctctcaccatcagcaacctgcaggctagaagntgtggctagtttatactgtacagcgtagttagttgtaggaacgtccgtcccgtcgttaccgtaccgttttccgggggacgggtaacgggggccccggtgggggttacggaggtacgttcgaaaggtacggttaaacgttggttacgggtccttcggaacctaccctagttccgttcggttctttaaccc

SEQ ID NO: 408382 - DNA, 550 bp, Homo sapiens
  misc_feature: GZ8MTXP01CZGP5.11.11.A11.1.454.CMB.2.raw
  modified_base (315)..(315): a, c, t, g, unknown or other
  modified_base (348)..(348): a, c, t, g, unknown or other
  modified_base (363)..(363): a, c, t, g, unknown or other
  modified_base (371)..(371): a, c, t, g, unknown or other
  modified_base (380)..(380): a, c, t, g, unknown or other
  modified_base (389)..(389): a, c, t, g, unknown or other
  modified_base (530)..(530): a, c, t, g, unknown or other
tcagcgagagataccacgaccggtgctcgatttagctacgactgcaggggcagcaagatggtgttgcagacccaggtcttcatttctctgttgctctggatctctggtgcctggtggggacatcctgatgacccagtccccagatatcctgcctgtgtctcgtgggcgagagggccaccatcgagtgcaagtccagcgagtacttctttatatagtgtacaaacgataaggtactatttagcttggtatcagacaaaaccaggacagcctactaaactgctcatctcctgggcatccgtaccccgggcacccggngtccctgaccgtattcgagtggcacggcgggtntgggacagaacttcnctctcacntcagcactncagctagantgtgacttagtttatacgtgtacaggactagttattgtagaacgtcctccgcttaccgtacgtttcggggacggtacggggcccgtgggtaggagtacgttacgaacggtacgaaccgttggttacggctacggcaccctnttacgtcgttaactttcccg

SEQ ID NO: 408383 - DNA, 536 bp, Homo sapiens
  misc_feature: GZ8MTXP01DC1E2.11.11.A11.1.454.CMB.2.raw
  modified_base (207)..(207): a, c, t, g, unknown or other
  modified_base (462)..(462): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtcccagatatcctgcctgtgtctctgggcgagagggccaccatcgagtgcaagtccagcgagacttcttttanatagtgtacaaacgataaggactatttagcttaggtatcagacaaaaaccaggacacgcctacctaaactgctcatctccgtggcatcctacccgggcacccggatccctgaccgattcagtgcaggcggtctggacagaacttcaactctcacatcagcaactgcaggctagaagatgtgctagtttatactgtacagtgtaagttattgagaacgtcctccgctactacgttcgggacggacgggaacccggngggtaggagtacgacgtaaggacgttaacgttggttacgggccttggccacctattcgttaacgttctttaacc

SEQ ID NO: 408384 - DNA, 632 bp, Homo sapiens
  misc_feature: GZ8MTXP01DFGNL.11.11.A11.1.454.CMB.2.raw
  modified_base (258)..(258): a, c, t, g, unknown or other
  modified_base (370)..(370): a, c, t, g, unknown or other
  modified_base (416)..(416): a, c, t, g, unknown or other
tcagcgagagataccacgaccggtgctcgatttagctacgactgcaggggcagcaagatggtgttgcagacccaggtcttcatttctctgttgctctggatctctggtgcctggtgggacatcctgatgacccagtccccagatatcctgcctgtgtctcgtgggcgagagggccaccatcgagtgcaagtccagcgagtacttcttttatatagtgtacaaagataaggacttattagcttggtatcagacaaaacnggacagcctactaaactgctcatcctctgggcatcccgtaccccggcaccccggacgtccctagaccgtattccgaggtcggcacggcgggtcgtagggacagtaaccttcncctctaccaaccactccgacgtaccaacctgcgaggctaagaagtntaggtgtacttaagttttactacgtgtactagtactaaggttattggtacgaacgtccctccggaccttacggtaccgttcggggccgggtaacggggcccggtaaggggttagggagtaacgttcggaaacgggtaacccggttaacgttggggttaccggtcccgttacggaaccctaacccttagtttccgttcggtttcccctttaacccgg

SEQ ID NO: 408385 - DNA, 556 bp, Homo sapiens
  misc_feature: GZ8MTXP01D7NE9.11.11.A11.1.454.CMB.2.raw
  modified_base (403)..(403): a, c, t, g, unknown or other
  modified_base (480)..(480): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagagggccaccatcgagtgcaagtccagcgagacttcttttatatagtgtacaaacgataaggacttatttagcttggtatcagacaaaaacaggacagcctcctaaaactgctcatctcctggggcatccgtacccgggcaccccggatccctgaccgattccagtggcacggcgggtctgggacagaaccttcaactctaccaccatcacgcaaacctgcaggctagaagattgnggtactagtttatactgttagctaggttattgtagacgtctaccgcttacgacgtttcggggcggtaagggcccggngggtggagagttccgaaagggaccgtaacgttggttacgggctggaccaaccgtgtccttagtcctttaagtaacc

SEQ ID NO: 408386 - DNA, 543 bp, Homo sapiens
  misc_feature: GZ8MTXP01BQKYO.11.11.A11.1.454.CMB.2.raw
  modified_base (338)..(338): a, c, t, g, unknown or other
  modified_base (345)..(345): a, c, t, g, unknown or other
  modified_base (353)..(353): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttatatagtgtacaaacgataaggactatttagcttggtatcagacaaaaaccaggacagcctctaaactgctcatctcctgggcatcctaccccgggcaccccggatccctgaccgattcagtgcagcgggtntgggacngaacttcnctctcaccatcagcaactgcaggctgaagatggtggactagtttatactgtacaggtgtagttagtgtagacgtccgtcgtctacgtacggttcgggacgggtacgggccggtgggtaggacgtacgttcgaacggtaaccgttacgttggacggtctcgaacctactcgttccgttcgttccttaaccg

SEQ ID NO: 408387 - DNA, 550 bp, Homo sapiens
  misc_feature: GZ8MTXP01EO17M.11.11.A11.1.454.CMB.2.raw
  modified_base (535)..(535): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttatatagtgtacaacgataaggactatttagcttgtatcagacaaaacaggacagcctcctaaactgctcatctcctggcatcctacccgggcacccggagtcccctgaccgattcagtcggcacgcgggtctgggacagaacttcaactctcaccatcagcaacctgcaggctgaagatgtgctagtttatactgttacagcgtaagttatttggtagagtcgtcccgcttacgtacgtttccggggccggtaacggggcccggtgggtggaagtacgttcgaaaggtacccgttaaagttggttacgggtctacggcctaacccgttnttcgttcgttcgttc

SEQ ID NO: 408388 - DNA, 624 bp, Homo sapiens
  misc_feature: GZ8MTXP01C1123.11.11.A11.1.454.CMB.2.raw
  modified_base (209)..(209): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgacaagtccagcgagacttcttttanatagtgtacaaacgataaggactatttagcttggtatcagacaaaaccaggacagcctactaaactgctcatcctcctgggcactccgtaccccgggccaccccggacgtccctgaccgtattcgaggtgcgacggcgggtcgtgggacacgtaaccttcaactcctaccaaccatacacgccaaacctgacaggctagaagtagtggtcggtacttaggtttattacgtgtacagtcgtaagtttagttgtacgtaacgtcccgtccggtccttaccgtaccggtttccggggacggggtacggggacccgtaaggggtcgggaggtaacgttacgaacggtaaccggttaaccgttgggttacggtccgttacggccctaaccctgttccgttaacgtttcccgtttaacccg

SEQ ID NO: 408389 - DNA, 550 bp, Homo sapiens
  misc_feature: GZ8MTXP01BVLP7.11.11.A11.1.454.CMB.2.raw
  modified_base (319)..(319): a, c, t, g, unknown or other
  modified_base (535)..(535): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagagggccaccatcgagtgcaagtccagcgagtacttcttttatatagtgtacaaacgataaggacttattagcttggtatcagacaaaacaggacagcctactaaactgctcatctctgggcatccgtaccggcacccggctccctgaccgnttcgagtggcacggcgggtctggggacagtaaccttcaactctccaccactcacgcaacctgacaggctagaacgtgtgtggtactagtttattacgtgtacagcgtagttagttgtgaacgtccgtccgtacttccgtacgtttccggggacggtacggggacccggcgggtggagtacttcgagaacgttacgttggttcggctcggcctacgnttcgtcgttcttccg

SEQ ID NO: 408390 - DNA, 680 bp, Homo sapiens
  misc_feature: GZ8MTXP01DB0XR.11.11.A11.1.454.CMB.2.raw
  modified_base (213)..(213): a, c, t, g, unknown or other
  modified_base (613)..(613): a, c, t, g, unknown or other
tcagcgagagataccacgaccggtgctcgatttagctacgactgcaggggcagcaagatggtgttgcagacccaggtcttcatttctctgttgctctggatctctggtgcctggtgggacatcctgatcgaccagtcccagatatcctgcctgtgtctcgtgggcgaggacgggccaccatcgagtgacaagtccagcgatacttacttttanatagtgtacaaagagtaaggtacttattagcttaggtatacaagaacaaaaacaggacacgaccctactaaactgctacatcctccgtcgggaccacgtacccgtaccccgggccgaaccccgggtacgtccccgtagaaccgtacttacgaggtcggcgaccgggtccggggtacgtacggggaactaacggtaacccttaccgtaacctcctaacccaaccctaactaccaacggacctaaacccggtacgacgtaacggtacgtaaggaaaggttacgttaggtacggttaactttaacggtttaacttacgtagtacgaagtacggttaagtttagttacgacgtaccgtccgtccgtacgttaccggttacggtccggggacgggtacgggcggngggtaagacgtacgacgaacggtacgttacgttcggcgctacgaactactcttcgttcgttccgtcc

SEQ ID NO: 408391 - DNA, 506 bp, Homo sapiens
  misc_feature: GZ8MTXP01DJM0M.11.11.A11.1.454.CMB.2.raw
  modified_base (209)..(209): a, c, t, g, unknown or other
  modified_base (343)..(343): a, c, t, g, unknown or other
  modified_base (357)..(357): a, c, t, g, unknown or other
  modified_base (436)..(436): a, c, t, g, unknown or other
  modified_base (483)..(483): a, c, t, g, unknown or other
  modified_base (492)..(492): a, c, t, g, unknown or other
  modified_base (499)..(499): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttanatagtgtcaaacgataaaggactatttagcttggtatcagacaaaaaaccaggacagcctcctaaaactgctcatctcctggcatccgtaccccgggcaccccggagtccctgaccgattcagtgcagcggtcngggacagaacttcnctctcacatcagcaacctgacaggctagaagatggtggactagtttattacgtgttaagctagttatgtagagctccgntctacgtttcgggcggagggaccgcggtggagatcgagacgaattgngctgcaacntccgttntcttctc

SEQ ID NO: 408392 - DNA, 641 bp, Homo sapiens
  misc_feature: GZ8MTXP01EW4ET.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaacgataaggacttattagcttaggtatcagacaaaaaccaggacagcctactaaactgctcatctctgggcactccgtaccccggccaccccggacgtccccgtagaccgtattccgaggtcggcgacggcggggtacgtggggaactacgtaacctttaccaaccttcctaccacccactaccacgacctaaacccgtgacaggctaggaagtagttggtggtactaaggtttacttacgtgtacaggtactaagtttagttaggtagtaaacgtccgtcccgcttaccgtacggtttccggggacgggtacggggacccgggtgggtagggacgtacgttacgaaagggtaacccggaaagttggttacgggtccttaggaacccgtacccgtatttccgttcggtttccgtttaacccg

SEQ ID NO: 408393 - DNA, 547 bp, Homo sapiens
  misc_feature: GZ8MTXP01CSDU9.11.11.A11.1.454.CMB.2.raw
  modified_base (471)..(471): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttatatagtgtacaaacgataaggactatttagcttggtatcagacaaaaaccaggacagcctacctaaactgctcatctcctgggcatcctacccggcaccccggatccctgaccgattcagtggcacggcgggtctgggacagtacttcaactctcaccatcagcaactgacaggctagaagatgtggactagtttatactgtcagctagttattgagaacgtcctccgtcttacgtacgttccgggacggtacggggacccggngggtggagtacgcgaaacggacgttaaacgttggttcggtaacgtcgaactaccctattcgtcgttcctttaaccg

SEQ ID NO: 408394 - DNA, 574 bp, Homo sapiens
  misc_feature: GZ8MTXP01CR81P.11.11.A11.1.454.CMB.2.raw
  modified_base (345)..(345): a, c, t, g, unknown or other
  modified_base (360)..(360): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagagggccaccatcgagtgcaagtccagcgagacttctttatatagtgtacaaacgataaggactattagcttggtatcaagacaaaaaccaggacagcctactaaactgctcatctccgtgggcatccgtaccccggcaccccggagtcccctgaccgtattcagtggcacggcggtntgggacagaacttcnctctcacatcagacaacctgcgaggctagaagatgtggtctagtttatactgtacagtcgtagttagttgacgtaacgtccgtccgtcttaccgtaccgtttcgggggaccggggtacggggtaccgggtcgggttagggacggtaacgttcgaaacggtacgaaacgttggttcggaactcggaaccactacgttcttcggttccttaacccg

SEQ ID NO: 408395 - DNA, 644 bp, Homo sapiens
  misc_feature: GZ8MTXP01EUQBW.11.11.A11.1.454.CMB.2.raw
  modified_base (219)..(219): a, c, t, g, unknown or other
  modified_base (392)..(392): a, c, t, g, unknown or other
  modified_base (550)..(550): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgaggacgggccaccatcgagtgcaagtccagcgagtacttcttttatatagtntacaacgataaggtacttattagcttggtatcagacaaaaccaggacacgcctacctaaactgctcactcctccgtgggctacgtccgtaccccgggaccaccccgggacgtcccctagaccgtattcgaggtcggcgacgggcgggtacgtacggggacacgtaaccttccncctcctaccaccctactaccacggaccaaaccgtgacgtacggctaggaaatgttaggtcgggtacttaaggtttataccgtagtaccagtagtaagtttagttgtacgacgtcctccgtcttaccgtacggttcggggaccggggacggggcccggngggttacggaagtacgttacggaaacggtaacggttaacgttgggttacgggtctacggaaccctaacgtcgttccgttcgtttccgtttcccg

SEQ ID NO: 408396 - DNA, 621 bp, Homo sapiens
  misc_feature: GZ8MTXP01CXX62.11.11.A11.1.454.CMB.2.raw
  modified_base (406)..(406): a, c, t, g, unknown or other
  modified_base (550)..(550): a, c, t, g, unknown or other
tcagcgagagataccacgaccggtgctcgatttagctacgactgcaggggcagcaagatggtgttgcagacccaggtcttcatttctctgttgctctggatctctggtgcctggtggggacatcctgatcgacccacgtccccagatactcctgcctgtgtctcgtgggcgaggacgggccaccatcgagtgacaagtccagcgagtacttcttttaatatagtgtacaaacgaataaggtacttatttagctttaggtatacaagaacaaaaaccaggaacacgaccctacctaaactcgctcatcctccgtgggcacgtcccgtaccccgggaccaccccggtacgtccccgtacgaccgtattcgaggtcggcgacggccgggtcgtggacacgtaaccttcnctctaccaccatacacgaccaaccgtgacacgggctaggaagagtggtacggtacttaaggtttacttacgtgtacaggtacgtaagttagttggacgtaacgtccctccgtcttacgtacggttcgggacggtacgggccggngggtagagtacgcgaacggacgttaacgttggacgtcctcgaacctactacgttcttaacgttcttaaccg

SEQ ID NO: 408397 - DNA, 564 bp, Homo sapiens
  misc_feature: GZ8MTXP01BPTQJ.11.11.A11.1.454.CMB.2.raw
  modified_base (205)..(205): a, c, t, g, unknown or other
  modified_base (211)..(211): a, c, t, g, unknown or other
  modified_base (399)..(399): a, c, t, g, unknown or other
  modified_base (424)..(424): a, c, t, g, unknown or other
  modified_base (427)..(427): a, c, t, g, unknown or other
  modified_base (480)..(480): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagacgggccaccatcgagtgcaagtccagcgagtacttnttttanatagtgtacaaagataaggacttattagcttagtatcaagacaaaaaccaggacagccctactaaactgctcatctcgtggcatccgtaccccgggcaccccggtagtcccctagaccgtattcgagtggcacggcggtgtgggacagtaacttcaactctcaccatcacgcaactgcaggctagaanagtgtaggtctagtttatactgtanagngtagtattgtagaagctccgctaccgtacgtttcgggacggtacgggcccggngggtggagtagttaccgaaggaaccgttaacgttggacggtcgttacggaaccgtaacccgttagttccgttcgttccgttccg

SEQ ID NO: 408398 - DNA, 595 bp, Homo sapiens
  misc_feature: GZ8MTXP01C3XVH.11.11.A11.1.454.CMB.2.raw
  modified_base (368)..(368): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttatatagtgtacaacgataaggtactatttagcttggtatcagacaaaaaccaggacagcctacctaaactgctcatctcctgggcatccgtaccccgggcaccccgggagtcccctgaccgtattcagtggcacggccggggtctggggacagtaaccttcnctctcaccatcagcaacctgcaggctgaacgtatggtgtactagtttattactgtacagtctagttagttgtagaacgtcctaccggtctaccgtacgtttccggggcgggtaacggggaccgcggggttagggagtacgttacgaacggtaacgaaccggttggttcggggccttacgggaacccgttaaccctgtttcccgtttcggtttcccgttttaaccccg

SEQ ID NO: 408399 - DNA, 566 bp, Homo sapiens
  misc_feature: GZ8MTXP01CIYIC.11.11.A11.1.454.CMB.2.raw
  modified_base (324)..(324): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagtacttcttttatatagtgtacaaacgataaggacttattagcttggatcagacaaaacaggacagcctactaaactgctcatctccgtggcatccgtaccccgggcaccccggagtccctgaccgtnttcagtggcacggcgggtctgggacagtaacttcaattctaccactatcagtccaaacctgacaggctagaagatggtagtactagtttatacgtgtactaggtactagttagttgtacgtaacgtccgtcccgtcttccgtaaccggtttccggggacgggtaccggggaccgggtcggtggaagcgttacgaacggacgttacgttggacggtctgccactgttcgttcgttcgttaacc

SEQ ID NO: 408400 - DNA, 517 bp, Homo sapiens
  misc_feature: GZ8MTXP01B7LE8.11.11.A11.1.454.CMB.2.raw
  modified_base (204)..(204): a, c, t, g, unknown or other
  modified_base (348)..(348): a, c, t, g, unknown or other
  modified_base (380)..(380): a, c, t, g, unknown or other
  modified_base (464)..(464): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagaggccacatcgagtgcaagtccagcgagactctttanatagtgtcaacgataaggactattagcttggtatcagacaaaaccaggacagccctctaaactgctcatctcctgggcatctacccgggcaccccggagtccctgaccgattcgagtcgcagcgggtctggggacagaacttcnctctcaccatcagcaacctgcagggctagaanagtgtggactagtttatactgtcagcgagttattcgtgaaacgtcttcccggcttccgtactttcggggcgggagggacccggnggtggagacttgagggacacgttggcggctagccaccattcgtgttctttaac

SEQ ID NO: 408401 - DNA, 709 bp, Homo sapiens
  misc_feature: GZ8MTXP01EIPAT.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctggtgggacatcctgatcgacccagtccccagatatcctgcctgtgtctcgtgggcgaggacgggccaccatcgagtgacaagtccagcgagtacttacttttatatagtgtacaaacgtataaggtacttatttagctttaggtactacaagaacaaaaaaccgaggaacacgaccctacctaaactcgactcactcctccgtgggacctacgtccccggtaccccggggaccgtaaccccggtacgtcccccgtacgtaccgtattcgaggtcggacgacgggtccggggtacgtacggggaccaacgtaaccttccaaccttcctaaccaacctaactaccgaacggaccctaaaccgtcggacgaacggtacgtaaggaaagtagttgggttacggtaaccttaaggtttaacttacgtagtacctaagtacgtaagtttagttagtacgtaaaccgtccgtcccgtacgttaccgtacggttaccggggacgggtacgggcccgggtgggtacggacgtacgttacgaacggtaacgttaaccgttggttacggtcgtcgaacctaccctagttcgttccgtttcttaacccg

SEQ ID NO: 408402 - DNA, 713 bp, Homo sapiens
  misc_feature: GZ8MTXP01DEKQC.11.11.A11.1.454.CMB.2.raw
  modified_base (469)..(469): a, c, t, g, unknown or other
tcagcgagagataccacgaccggtgctcgatttagctacgactgcaggggcagcaagatggtgttgcagacccaggtcttcatttctctgttgctctggatctctggtgcctggtggggacatcctgatgacccagtccccagatatcctgcctgtgtctcgtgggcgaggacgggccaccatcgagtgacaacgtccagcgagtactttctttaatatagtgtacaagaagtaaggtacttattagtcttaggtatacaagaaccaaaaaccgaggaacacgaccctacctaaactgacctacattccgtcgtacgggacctacgtcccggtaccccgggaccgaccccggtacgtccccgtacggaaccgttacgtttaccgagggtcggacgtaaccgggggtccggggttagtacgggggaacctacgtaaaccctttaccaacccttcctaacccaacccttanaccgaccgacctaaacccgtgaccgtaaggccgttaaggaaggtacgtgggttacggtactttaagtttacgttactgtacagtggttaagttaagttgtacgacgtcctcgtacttacgtacggttccgggacgggtacggggcccgtgggtagggacgtagttacccgaaggggtaaacccttcggttgggacggccttcggaaccctaacccgtcttacggttcccgtttcctttaacccg

SEQ ID NO: 408403 - DNA, 558 bp, Homo sapiens
  misc_feature: GZ8MTXP01BGADQ.11.11.A11.1.454.CMB.2.raw
  modified_base (355)..(355): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggacttattagcttggtatcagacaaaaaccaggacagcctctaaactgctcatctcctgggcatccgtacccgggcacccggagtcccctgaccgattcgagtggcacgcgggtctgggacagaacttcnctctcacatcagcaactgcaggctagaagatggtggctagtttatactgtacagcgtagttattgagaagtcctccggctacgtacgtttccggggcgggtaacgggccgggtcgggttggaggtacttcgaaacggaaccggttaacgttgggttacgggtcctgggcctaaccctagttccgttcggtttcctttaacccg

SEQ ID NO: 408404 - DNA, 621 bp, Homo sapiens
  misc_feature: GZ8MTXP01DZBD6.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagagggccaccatcgagtgcaagtccagcgagacttcttttatatagtgtacaaacgataaggacttatttagctttggatcagacaaaaccaggacagccctacctaaactgctcatctccgtgggcacgtcccgtaccccgggcaccccggtagtcccctagaccgtattccgaggtcggacgtacggcggggtactggggaacctacgtaaccttcaactcctacacccataccagacctaacctgaccaggtctaggaagtagtaggttcgacttagtttataacttgtaccagtacgttaagtttagttagtagtaacgtcccgtaccgtcttaccgtaccggtttcggggacgggtacgggtcccgggtgggtaggacgtaacgttacggaaacggtaacgttacgttggttcggctcgaacctaccctgttccttcgttaaccttccg

SEQ ID NO: 408405 - DNA, 532 bp, Homo sapiens
  misc_feature: GZ8MTXP01BJXJ6.11.11.A11.1.454.CMB.2.raw
  modified_base (257)..(257): a, c, t, g, unknown or other
  modified_base (358)..(358): a, c, t, g, unknown or other
  modified_base (384)..(384): a, c, t, g, unknown or other
  modified_base (477)..(477): a, c, t, g, unknown or other
  modified_base (486)..(486): a, c, t, g, unknown or other
  modified_base (520)..(520): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagaggccaccatcgagtgcaagtccagcgagacttcttttatatagtgtacaaacgataaggacttatttagcttggatcagacaaaaaccnggacagcctactaaactgctcatctcctggcactccgtaccccgggcacccggacgtccctgaccgattcaggtgcacggcgggtctgggacagtacttcnctctcaccatcacgcaaacctgacgngcgtagaagtatgtggactagtttattactgtcagacgtagtagttgtagaacgctccgcttccgtacgttcgggacgggacgggacccgggnggtacgganacgttacgacgtacgacgttgcgtctcgcctctnttctcgttcgtc

SEQ ID NO: 408406 - DNA, 551 bp, Homo sapiens
  misc_feature: GZ8MTXP01AHVQR.11.11.A11.1.454.CMB.2.raw
  modified_base (480)..(480): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttatatagtgtacaacgataaggactatttagcttggtatcaagacaaaaaccaggacagcctacctaaactgctcatctcctgggcatccgtaccccgggcaccccggagtcccctgaccgtattccagtcggcacggcgggtctggggacagaacttcaactctcaccatcagcaacctgcaggctagaatagtgtggctagtttattactgtcagcgtagttattgagaacgtcgtaccgctcgtacgttcgggacgggtacggggacccggngggtaggagtacttcgaacgtacgaacgttggttacggctcggcctaccgtattccttcgttctttaaccg

SEQ ID NO: 408407 - DNA, 562 bp, Homo sapiens
  misc_feature: GZ8MTXP01E0YQO.11.11.A11.1.454.CMB.2.raw
  modified_base (348)..(348): a, c, t, g, unknown or other
  modified_base (402)..(402): a, c, t, g, unknown or other
  modified_base (546)..(546): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaaacgataaggacttatttagcttggtatcagacaaaaaccaggacagcctactaaactgctcatctcctgggcatccgtaccccgggcaccccggagtcccctagaccgattcagtggcacggcgggtntggggacagtaacttcaactctcaccatcagcaactgcaggctagaagattggnggtctagtttatactgtacagctagttattgagaacgtcctccgcttaccgtacggtttccggggacgggtacgggggaccgtcggggttggaagtacgttcgaaaggaacgaacgttgggttcgggcctggccctaacccgtnttccgttcgttcctcg

SEQ ID NO: 408408 - DNA, 606 bp, Homo sapiens
  misc_feature: GZ8MTXP01D8L3Y.11.11.A11.1.454.CMB.2.raw
  modified_base (586)..(586): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgaccagtcccagatatcctgcctgtgtctcgtgggcgagagggccaccatcgagtgcaagtccagcgagacttcttttatatagtgtacaacgataaggacttatttagcttggtatcaagacaaaaaccaggacacgcctacctaaactgctcactcctccgtgggccacgtccgtaccccgggcgaccccgggacgtccccgtgaccgtattcgaggtcgcgacggcgggtcagggacagtaaccttcaactctacaccatcacgcaacctgcaggactagaaagtgtggtagtacttaagtttacttacgtgttaccgagcgttaagttacgtttaggtacgtaaagtcccgttaccgctttaccgtaccgtttcgggggaccgggtaaggggaccccggtgggtaggaggtacttacgaacgaacgttacgttggttcggcgtcgaaccgtaccngttcttcgttcctttaaccg

SEQ ID NO: 408409 - DNA, 564 bp, Homo sapiens
  misc_feature: GZ8MTXP01DTAE6.11.11.A11.1.454.CMB.2.raw
  modified_base (345)..(345): a, c, t, g, unknown or other
  modified_base (359)..(359): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagagggccaccatcgagtgcaagtccagcgagtacttcttttatatagtgtacaaacgataaaggacttattagcttaggtatcagacaaaaaccaggacagcctactaaactgctcatctccgtggcatccgtaccccggcaccccggagtccctgaccgtattcagtgccagcggtntggacagaccttcnctctacaccatcagcaaactgcaggctagaagtataggtgtctaagtttattacgtgtacagtagtagttagttagtagtaacgtcctccgtcgtacgtacgtttccggggaccggtacggggaccggtcgggttagggagtacgttcgaagtacgaaacgttggttacggtctacgcctaccgacttcgttcgttcctttaacc

SEQ ID NO: 408410 - DNA, 568 bp, Homo sapiens
  misc_feature: GZ8MTXP01AW18C.11.11.A11.1.454.CMB.2.raw
  modified_base (256)..(256): a, c, t, g, unknown or other
  modified_base (272)..(272): a, c, t, g, unknown or other
  modified_base (337)..(337): a, c, t, g, unknown or other
  modified_base (485)..(485): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagagggccaccatcgagtgcaagtccagcgagacttcttttatatagtgtacaacgataaggactatttagcttggtatcagacaaaacnggacagcctcctaaangctcatctctgggcatccgtacccggcacccggatcccctgaccgattcagtggcacggcgggtntgggacagaaccttcaactctacaccatcacgacaaccctgccaggctagaagagtgtggactaggtttacttactgtcagcgtaaggttattgtagaacgccttcccggcttaccgtacgtttcggggacgggtacggggcccgggngggtggggatcgttcgaaggtaccggttaaacgttgggttcggtaacgtggcctaacccgttcttccgttcgttccgttaacg

SEQ ID NO: 408411 - DNA, 637 bp, Homo sapiens
  misc_feature: GZ8MTXP01EFS9G.11.11.A11.1.454.CMB.2.raw
  modified_base (286)..(286): a, c, t, g, unknown or other
  modified_base (453)..(453): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttatatagtgtacaaacgataaggtacttattagcttaggtatcagacaaaacaggacagcctactaaactgctcatctcgnggcactccgtacccggacacccggtacgtccctgaccgtattcgagtggacgacggcgggtcgtaggggacacgtaaccttcaactcctaccaaccactaccacgaccaaacccgtgaccgaaggtcaggaaagtagtgtggtactagtttattactagtacaggtntaagttagttgtacgtaacgtcctaccgtcgttaccgttaccgtttcgggggacggtaacgggggaacccggcggggttaagggaaccggtaattaccggaaacggtaacccggttaaagttcggttacgggtccgttacggaaccctaaccctagttcccggttcgtttccgttttaaccccg

SEQ ID NO: 408412 - DNA, 543 bp, Homo sapiens
  misc_feature: GZ8MTXP01BA8HO.11.11.A11.1.454.CMB.2.raw
  modified_base (341)..(341): a, c, t, g, unknown or other
  modified_base (393)..(393): a, c, t, g, unknown or other
  modified_base (416)..(416): a, c, t, g, unknown or other
  modified_base (418)..(418): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaaacgataaggacttatttagcttggtatcagacaaaaaccaggacagcctacctaaactgctcatctctgggcatcgtacccgggcacccggatccctgaccgattcagtggcacgcgggtntgggacagaacttcaactctcaccatcagacaaccctgcagggctagaaagntggtggctagtttatactgtacngntagtattgagaagtcctccgctactacgtttcgggacggacgggaccgcgggtggaggacttaccgaaggaccgaaacgttgggttcgggccttggcccaaaccgttcgttcgttcgttccttcg

SEQ ID NO: 408413 - DNA, 658 bp, Homo sapiens
  misc_feature: GZ8MTXP01CM6OJ.11.11.A11.1.454.CMB.2.raw
  modified_base (398)..(398): a, c, t, g, unknown or other
tcagcgagagataccacgaccggtgctcgatttagctacgactgcaggggcagcaagatggtgttgcagacccaggtcttcatttctctgttgctctggatctctggtgcctggtgggacatcctgatgacccagtccccagatatcctgcctgtgtctcgtgggcgagagggccaaccatcgagtgacaagtccagcgagtacttcttttaatatagtgtacaaagataaaggacttattagcttaggtatcaagaacaaaacaggacagcctactaaatgctacatcctccgtagggctactccgtaccccggcaacccggacgtccccgtgaccgtattcgacgtggcgacggcggggtagtcgggaacacgtaacttcaacttcaccaactacncaacgaccaaacccgtgacgacggacgtagaaagtgttacgtacgggtacttaacggtttaattaaccgttcgttaacgaacggttacgtaaagtttaggtttagacggttaaacggccctaccgttcgtaaccgttaacggtttccggggacgggaccggggttaacccggggtcgggtaaggacgtacgttacggaaacggtaacgttacggttcggttacgcgtacgtaacctacgtacttccgttcgttccgttcg

SEQ ID NO: 408414 - DNA, 599 bp, Homo sapiens
  misc_feature: GZ8MTXP01BKNZL.11.11.A11.1.454.CMB.2.raw
  modified_base (211)..(211): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagagggccaccatcgagtgacaagtccagcgagtacttcttttanatagtgtacaaacgataaggacttattagcttgatcagacaaaacagacagcctactaaactgctcatctccgtgggcactccgtacccgggccaccccgggactcccctgaccgtattcgagtggcacggcgggtgtgggacagaacttcaactctcacactcacgacaacctgcgaggcgtagaagtagtggtacggtactaggtttacttacgtgtacgagtagtagtttagttcgtacggaacgtccgtcccgtacgttccgtaaccggtttcggggaccggggtacggggtacccgggtggggtacggaggtacgttacggaacggaacgttaacggttggttcgggtctcggaactaacccgttcgttcgttcgttcctccg

SEQ ID NO: 408415 - DNA, 568 bp, Homo sapiens
  misc_feature: GZ8MTXP01B17UF.11.11.A11.1.454.CMB.2.raw
  modified_base (262)..(262): a, c, t, g, unknown or other
  modified_base (346)..(346): a, c, t, g, unknown or other
  modified_base (361)..(361): a, c, t, g, unknown or other
  modified_base (395)..(395): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagtacttcttttatatagtgtacaaacgataaggacttatttagcttggtatcagacaaaaaccnggacagcctactaaactgactcatctcctgggcatccgtacccggcaccccggatccctgaccgtattcagtgcacggcgggtntgggacagaacttcnctctcaccatcacgcaacctgcaaggctagaagntggtggctagtttactactgtacagtcgtaagttatcgtagaactccgtccgctcgtaacgttcggggacggacgggcccggtgggtaggagtacgttcgaaaggtaaccggaacgttgggttacgggtctacggaacctaaacccggtcgttaccttcggtttccgttcccg

SEQ ID NO: 408416 - DNA, 591 bp, Homo sapiens
  misc_feature: GZ8MTXP01BQ84O.11.11.A11.1.454.CMB.2.raw
  modified_base (262)..(262): a, c, t, g, unknown or other
  modified_base (320)..(320): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtcccagatatcctgcctgtgtctcgtgggcgagacgggccaccatcgagtgcaagtccagcgagtacttcttttaatatagtgtacaaacgtataaaggtacttattagcttggtatcagacaaaacnggacagcctactaaactgctcatctccgtggcatccgtaccccggcacccggatcccngaccgtattcgagtcgcacggcgggtctagggacagtaaccttcaactctacacctataccacgaccaaacgtcgacgaggctagaagtagtggtacggtacttagtttacttactagtacaaggtctaaggttagttagacgtaacgtcctccggtcttaccgtacgtttccggggacgggtacgggcccggtgggtagagtacttacgaacggaacgttaacgttggcggtaactcggaacctaccgtattccggtcgttcgttaaccg

SEQ ID NO: 408417 - DNA, 694 bp, Homo sapiens
  misc_feature: GZ8MTXP01CWUZI.11.11.A11.1.454.CMB.2.raw
  modified_base (212)..(212): a, c, t, g, unknown or other
tcagcgagagataccacgaccggtgctcgatttagctacgactgcaggggcagcaagatggtgttgcagacccaggtcttcatttctctgttgctctggatctctggtgcctggtgggacatcctgatgacccagtcccagatatcctgcctgtgtctcgtgggcgaggagggccaccatcgagtgacaagtccagcgagacttcttttaanatagtgtacaaagataaggacttatttagcttaggtatacaagaacaaaaaccaggaacacgaccctacctaaaactgacctacatcctccgtagggaccacgtacccgtaccccgggaccaaccccggacgtcccctacgaccgtattcgaggtcggacgacggccggggtacgtggggactacggtaaccttccaacttcctaccaacctacaccgaacgaccaaacccgtgaccgaggtactaggaaagtagtaggtaggtacttaaggttttaactacgttagtacgagtacggtagtttaagtttagagtaaacgtccgttcccgtacgttaccgttaccggtttccgggggacggggtaaccgggggacccggtgggtagggaacgtacgttacggaaacggtaaccggttaacgttggttacgggtaactacgggaacccaaaccgttacttccggttcgtttccgtttaacccg

SEQ ID NO: 408418 - DNA, 603 bp, Homo sapiens
  misc_feature: GZ8MTXP01COJ05.11.11.A11.1.454.CMB.2.raw
  modified_base (371)..(371): a, c, t, g, unknown or other
  modified_base (411)..(411): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagacttcttttatatagtgtacaacgataaggacttatttagcttggtatcagacaaaacaggacagcctactaaactgctcatctcctgggcactccgtacccgggccacccggacgtccctagaccgtattccgaggtcggcgacggccgggtcgtgggacagtaaccttcnctctaccactatcacgcaaacctgacgacggctaggaagngttaggtcggacttaggttttatacgtgtacagtacgtagttagttgtacggaacgtcgtcccgtcttaccgtaccgtttccgggggacgggtacggggccggtcggggtagggacgtacgttacgaacggtacgttaacggttcgggttacggcctggtcccaacgtcgttcgttcggttcctttaacccg

SEQ ID NO: 408419 - DNA, 574 bp, Homo sapiens
  misc_feature: GZ8MTXP01AGG19.11.11.A11.1.454.CMB.2.raw
  modified_base (261)..(261): a, c, t, g, unknown or other
  modified_base (373)..(373): a, c, t, g, unknown or other
  modified_base (398)..(398): a, c, t, g, unknown or other
  modified_base (414)..(414): a, c, t, g, unknown or other
  modified_base (433)..(433): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagtacttcttttatatagtgtacaaacgataaggacttatttagcttaggtatcagacaaaacnggacagcctactaaactgctcatctcgtgggcatcccgtacccgggcaccccggagtccctgaccgtattcaggtcgcacggcggtctgggacagaacttcaactcctcacntcagcaactgcagctagagatgtgntagttattactgtcancgtagttagttgagtaacncgtccgcttacgtacggtttcgggacgggtacggggccggtcgggtacggagtacgttacggaacggtaaccggttaaccggttgggttcgggccttacggccctaaaccgtacttcccgttaacggttcccgtttaaccg

SEQ ID NO: 408420 - DNA, 620 bp, Homo sapiens
  misc_feature: GZ8MTXP01AJIF6.11.11.A11.1.454.CMB.2.raw
  modified_base (360)..(360): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagagggccaccatcgagtgcaagtccagcgagacttcttttatatagtgtacaaacgataaggacttatttagcttggtatcagacaaaaaccaggacagcctacctaaactgctcatctcctgggcatcctacccggcacccggagtccctgaccgattccagtcggcacgcgggtctgggacagaaccttcnctctcacatcagcaacctgcaggctagaagatcggtggctagtttatacgtgtacaggtctaagttagttgtagaacgtccttccggccttacgtaaccgttttccgggggaccgggtaacggggggtccccggtcggggttgggaaacggtacgttacccggtaagggaacccggttaaacccggttgggttaccggggtccttacggggaaccctaaccccggtaattccccggtttcggtttccccgttttaacccg

SEQ ID NO: 408421 - DNA, 569 bp, Homo sapiens
  misc_feature: GZ8MTXP01AVYIP.11.11.A11.1.454.CMB.2.raw
  modified_base (254)..(254): a, c, t, g, unknown or other
  modified_base (337)..(337): a, c, t, g, unknown or other
  modified_base (392)..(392): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagaggccaccatcgagtgcaagtccagcgagacttcttttatatagtgtacaaacgataaggactattagcttggtatcagacaaaacnggacagcctctaaactgctcatctccgtggcatcgtaccccggacaccccggagtccctgaccgattcagtcgcacgcgggtntgggacagaaccttcaactctaccacatcacgctaaaccctgacaggtctagaanagtgtcggctagttattactgtacaagcgtaagtgtttgagtaacggcttcccggacttccgtaacgttttccggggacgggtaaccggggcccgaacggggttggaacggtagttcgaacgacggttaaacgttcggttggcgttcggcccttaaccgtcttcgtcgttccgttcg

SEQ ID NO: 408422 - DNA, 548 bp, Homo sapiens
  misc_feature: GZ8MTXP01DFGEL.11.11.A11.1.454.CMB.2.raw
  modified_base (474)..(474): a, c, t, g, unknown or other
tcagcgagagataccacgaccggtgctcgatttagctacgactgcaggggcagcaagatggtgttgcagacccaggtcttcatttctctgttgctctggatctctggtgcctggtggggacatcctgatgacccagtccccagatatcctgcctgtgtctctgggcgagagggccaccatcgagtgcaagtccagcgagacttcttttaatatagtgtacaaacgataaaggacttatttagcttaggtatcagacaaaaaccaggacagcctactaaactgctcatctctggcatccgtacccggcaccccggatccctagaccgattcgagtggcagcgggtctgggacagaacttcaactctcaccatccagacaaaccctgacaggctaggaagtagtgtggactagtttaatactgtcagtctagtattgagaagtcctcgctcgtacgttcggcgggacggacccggnggtgagtacgttacgaagaacgttacgttggttacggtctacgaaccgtacctagttccgttcgttccttaacg

SEQ ID NO: 408423 - DNA, 570 bp, Homo sapiens
  misc_feature: GZ8MTXP01AV6NT.11.11.A11.1.454.CMB.2.raw
  modified_base (365)..(365): a, c, t, g, unknown or other
  modified_base (549)..(549): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaaacgataaggacttatttagcttggtatcagacaaaaccaggacagcctacctaaactgctcatctccgtgggcactccgtaccccgggcaccccggatcccctgacccgattcaggtggcacggcgggtctgggacagaacttcnctctcaccatcagcaacctgcaggctagaagatggtaggactagttttatacgtgtacagcgtagttattgtagaacgtccgtccgtcttaccgtacgtttccggggacgggtacgggaccggtcgggtggagtacgttaccgaaggtaaccggaacgttggcgggctcggaacctaacccgtnttccgttcgttccgtttcccg

SEQ ID NO: 408424 - DNA, 560 bp, Homo sapiens
  misc_feature: GZ8MTXP01D0E4U.11.11.A11.1.454.CMB.2.raw
  modified_base (256)..(256): a, c, t, g, unknown or other
  modified_base (349)..(349): a, c, t, g, unknown or other
  modified_base (402)..(402): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttctttatatagtgtcaaagataaggactattagcttaggtatcagacaaaaaccnggacagcctcctaaactgctcatctcctgggcatcctacccgggcacccggatccctgaccgattcagtgcaggcggtctgggacagacttcnctctcaccatcagcaactgcaggctgaagatgtggtctagtttatactggtanacggtataggttattggtagaacgtccttccggcttacgtacgtttccggggacggtacggggacccggtgggttggagtacgttaccgaagggtaaccgttaaacgttgggttacgggcttaggaacctacccgattctttaacggttctttaaccg

SEQ ID NO: 408425 - DNA, 627 bp, Homo sapiens
  misc_feature: GZ8MTXP01A2HDR.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagagggccaccatcgagtgcaagtccagcgagtacttcttttatatagtgtacaacgataaggacttattagcttaggtatcagaacaaaacaggacacgcctacctaaactgctcatcctccgtggggacctacgtcccgtaccccgggccaccccgggacgtcccctagaccgtattcgaggtcggccgacggcgggtcgtacggggacacgtaaccttcaactctaccaccactaccaacgaccaaaccctgaccgaggactaggaagtataggtcggtacttaagtttacttactagtacagtacgtagttagttgtacgacgtcctcgctaccgtacgtttcggggacgggtacgggccggcgggtaggacgtacgttcgaaacggtaacgttaacgttgggttaccggtcgttaccggaacctaaccggtacttccgttcgttccgtttaacccg

SEQ ID NO: 408426 - DNA, 580 bp, Homo sapiens
  misc_feature: GZ8MTXP01DLF7L.11.11.A11.1.454.CMB.2.raw
  modified_base (288)..(288): a, c, t, g, unknown or other
  modified_base (325)..(325): a, c, t, g, unknown or other
  modified_base (356)..(356): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagagggccaccatcgagtgcaagtccagcgaagtacttcttttatatagtgtacaaacgataaggtactattagcttggtatcagacaaaacaggacagcctactaaactgctcatctccgnggcactccgtacccggcaccccggatccctgaccgtnttcagtgcacgcggtgtggacagaaccttcnctctcaaccatcagacaacctgcgaggctagaagtagtggtacggtacttagtttactactggtactaggactagttagttgtacgaagtccgtccgtcgttaccgtacgtttccggggacgggtaacggggcccggtcgggtagggagtacgttacgaaggtaacgttaaccggttggttacgggtctacggtcctaaccgtacttcgtcgttcctttaaccg

SEQ ID NO: 408427 - DNA, 576 bp, Homo sapiens
  misc_feature: GZ8MTXP01C7RHZ.11.11.A11.1.454.CMB.2.raw
  modified_base (210)..(210): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttaanatagtgtacaaacgataaaggacttatttagcttggtatcagacaaaaccaggacagcctactaaactgctcatctcctgggacatccgtaccccgggcaccccggagtccctgaccgtattcagtgcacggcgggtctgggacagtaacttcaactctcaaccatcacgacaacctgcaggctagaagtatgtggactagttttatacgtgtacgaagtgtagttgtaggtacgacgtccgtccgtcttacgtaccggttcggggaccgggtacgggtaccggtcgggtaggacgtacgttacgaacggtaacgttacggttcgttacgggtctacgaacctactcgttcgttcgttccgttaac

SEQ ID NO: 408428 - DNA, 618 bp, Homo sapiens
  misc_feature: GZ8MTXP01EDUP7.11.11.A11.1.454.CMB.2.raw
  modified_base (524)..(524): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgaggacgggccaccatcgagtgacaagtccagcgagtacttcttttatatagtgtacaaacgtataaaggtacttattagcttaggtatacagacaaaaaccaggacacgcctactaaactgctcactctccgtggctacgtccgtacccggacaccccggtcgtccctgaccgtattacgacgtggcgacggtccgggtacgtacggacacgtaacttcaactctaccaaccactaccacgacaaaccgtcgcgaggtctaggaatagtggtacgtacttagtttactagtgtacgagtcgtagttagtgtacgactcgtccgtctacgtacggttccgggacgggacggaccgggnggtggttaacggtacttacggaaacgtacggttaacgttcggttacgggtcctaggtaaccaacccgtagttccggtttcgttccgtttaaccg

SEQ ID NO: 408429 - DNA, 543 bp, Homo sapiens
  misc_feature: GZ8MTXP01DLAB3.11.11.A11.1.454.CMB.2.raw
  modified_base (208)..(208): a, c, t, g, unknown or other
  modified_base (370)..(370): a, c, t, g, unknown or other
  modified_base (429)..(429): a, c, t, g, unknown or other
  modified_base (470)..(470): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtcccagatatcctgcctgtgtctctgggcgagagggccaccatcgagtgcaagtccagcgagacttcttttanatagtgtacaaacgataaggactatttagcttggtatcagacaaaaccaggacagcctactaaactgctcatctcctggggcatccgtaccccgggcacccggagtccctgaccgattcagtggcacgcgggtctgggacagtacttcaactctcacatcancaactgcaggctagagatgtggctagtttactactgtacagcgtagttattgtagaacncgtaccgcttaccgacgtttcgggacggtacgggacccggngggtgagcgttacgaggacgaaacgttggttacggccgttgaaccgaccctagttccgttcgttaactttccg

SEQ ID NO: 408430 - DNA, 606 bp, Homo sapiens
  misc_feature: GZ8MTXP01BMLAL.11.11.A11.1.454.CMB.2.raw
  modified_base (264)..(264): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgaggacgggccaccatcgagtgacaagtccagcgagtacttcttttatatagtgtacaaacgtataaggtacttatttagcttggtatcagacaaaacnggacagcctactaaatgactcatctcctggcctatccgtacccggcacccggcgtccctgaccgtattcgaggtcggacgacggcgggtcgtacgggactacgtaaccttccaactcctaccaccactcacgaccaacctgactaggctagaatgtggtaggtacttagtttactacgtgtacgacggtatagttaagttgacgtacgtcccgtaccgtcgtaccgttacggttcggggacgggtacgggaccggtcgggtaggagtacgttacgaacgtacgttaacgttcggttcggtaactcgaacctaaccgtgttccgttaacgttccgtttaaccg

SEQ ID NO: 408431 - DNA, 641 bp, Homo sapiens
  misc_feature: GZ8MTXP01C25QR.11.11.A11.1.454.CMB.2.raw
  modified_base (199)..(199): a, c, t, g, unknown or other
  modified_base (205)..(205): a, c, t, g, unknown or other
  modified_base (233)..(233): a, c, t, g, unknown or other
  modified_base (239)..(239): a, c, t, g, unknown or other
  modified_base (243)..(243): a, c, t, g, unknown or other
  modified_base (266)..(266): a, c, t, g, unknown or other
tcagcgagagataccacgaccggtgctcgatttagctacgactgcagggcagcaagatggtgttgcagacccaggtcttcatttctctgttgctctggatctctggtgcctgtgggacatcctgatgaccagtcccagatatcctgcctgtgtctcgtgggcgagagggccacatcgagtgcaagtccagcgagacttnttttanatagtgtacaaagataaggactattagnttgtanacanaacaaacagacacactactaatnctcatcgtcgtcggactacgtccgacccggaccgacccggtacgtccctacgaccgtatacgaggtcggacgaccggtacgggtacggtacggacgacgtaaccttacctaacctacctaccaacctactacacgacaaccgtacgacgacggacgtagaagtagtaggtagtacgttaacgtttaacgttacgtacgtacgacgtacggtagttaagttagtacgtaacgtccgtccgtaccgtaccgtaccggttaccgggtaccgggaccggggaccgggtaacgggtacgggaggtaacgttacgaacggtaacggttaacgttcggttcggtcgtcgtaaccgtacctacttacgttcgttcgttaaccg

SEQ ID NO: 408432 - DNA, 599 bp, Homo sapiens
  misc_feature: GZ8MTXP01DETXE.11.11.A11.1.454.CMB.2.raw
  modified_base (333)..(333): a, c, t, g, unknown or other
  modified_base (378)..(378): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagtacttcttttaatatagtgtacaaacgataaggacttatttagctttaggatcagacaaaaaccaggacagcctacctaaactgctacatcctcgtgggcatcccgtacccgggcacccggacgtccctggacctnttcagtcggcacggcgggtactggggacagtaaccttcaacttcncaccatcagcaactgcaggtcagagtagtgtgtactagtttactatgtacacgaggtagttagttaggtaggaaacgtccgtccggtcttacccgttaacggttttccggggcgggacggggttaacccggggtcgggtaggagtacgttacgaaacggtaccgttaacggttcggttacggtctaccgaacctaaccgtcttcgttccgttccgtttaac

SEQ ID NO: 408433 - DNA, 734 bp, Homo sapiens
  misc_feature: GZ8MTXP01BI9CT.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagtacttcttttatatagtgtacaaacgataaggtacttatttagctttggtatcaagacaaaacaggacacgcctactaaactgctcatcctccgtgggcctacgtcccgtaccccggggacacccccgggtagtcccccgtagacccggtattcgaaggtcggccgagggtccggggtacgtagggggaaccacggtaaacccttaccaacccttacctacccaacccgtactccgaacgggtaccctaaaccccgtgaccgacgggtaccgttaaggaaacggtagttacgggtagggttacctttaaagggtttttaacttaaccgtggttaaccaggtacgttaaggtttaagttcgtaacgtaaacgtcccgttcccgtacttacccggttaacggtttccggggaaccgggtaccgggggtacccggtccggggttaggagggtaccttacggaaacggtaacccggttaaagttcgggttacggtccgttacggaaccctaccgtatttccgtcgtttcccttaacccg

SEQ ID NO: 408434 - DNA, 541 bp, Homo sapiens
  misc_feature: GZ8MTXP01DWJXM.11.11.A11.1.454.CMB.2.raw
  modified_base (259)..(259): a, c, t, g, unknown or other
  modified_base (357)..(357): a, c, t, g, unknown or other
  modified_base (386)..(386): a, c, t, g, unknown or other
  modified_base (529)..(529): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttatatagtgtacaaacgataaggacttattagcttggtatcagacaaaaaaccnggacagcctcctaaaactgctcatctcctgggcatcctacccgggcacccggagtcccctgaccgattcagtggcagcgggtctgggacagaacttcnctctcaccatcagcaacctgcagctgaanatgtggctagtttatactgtacagtgtaagtatttgagaacgtcctccggcttactaccgtttcggggcgggtaacgggcccggaaggttgggaacggtattaccgaaggaacgaacgttggttacgggctaggccaaccttnttcttcgttctc

SEQ ID NO: 408435 - DNA, 501 bp, Homo sapiens
  misc_feature: GZ8MTXP01ANYUU.11.11.A11.1.454.CMB.2.raw
  modified_base (206)..(206): a, c, t, g, unknown or other
  modified_base (334)..(334): a, c, t, g, unknown or other
  modified_base (348)..(348): a, c, t, g, unknown or other
  modified_base (483)..(483): a, c, t, g, unknown or other
  modified_base (487)..(487): a, c, t, g, unknown or other
  modified_base (490)..(490): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagaggccaccatcgagtgcaagtccagcgagactcttttanatagtgtcaaacgataaggactatttagcttggtatcagacaaaaccaggacagcctactaaatgctcatctcctgggcatcgtaccccgggcaccccggatccctgaccgattcagtgcaggcggtntgggacagacttcnctctcaccatcgacacaaccctgaccaggctagaagatgtggctagtttatactgtcagcagtatgtacgaacgtctccgctcgtacttcgggcggtaacgggcgcgggtgagcttgaggcaacgttgttcggcncgcnctnttctcgttctc

SEQ ID NO: 408436 - DNA, 539 bp, Homo sapiens
  misc_feature: GZ8MTXP01EOOZE.11.11.A11.1.454.CMB.2.raw
  modified_base (357)..(357): a, c, t, g, unknown or other
  modified_base (388)..(388): a, c, t, g, unknown or other
  modified_base (395)..(395): a, c, t, g, unknown or other
  modified_base (523)..(523): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttatatagtgtacaaacgataaggacttattagcttggtatcagacaaaaaccaggacagcctacctaaatgctcatctcctgggcatcctacccgggcacccggatcccctgaccgtattcagtcgcacgcggtctgggacagtaaccttcnctctcaccatcagcaactgcaggctagaagntgcggtntagtttatacgtgtacagcgtaagttattgtagaacgtcctccgtcttacgtacgtttcgggacgggtacggggcccggtgggtaggagtacgttacgaggaacgaacgttggacgtctggcctacgnttcgtcgttaacttcc

SEQ ID NO: 408437 - DNA, 554 bp, Homo sapiens
  misc_feature: GZ8MTXP01AZ6IA.11.11.A11.1.454.CMB.2.raw
  modified_base (375)..(375): a, c, t, g, unknown or other
  modified_base (384)..(384): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaaacgataaggactatttagcttggtatcagacaaaacaggacagcctacctaaactgctcatctcctgggcacgtccgtaccccgggcaccccggacgtccccgtgaccgattcgaggtcgcgacggcgggtctgggacagacttcaactctcacntcagcaatncgagctagaagtatggtgtctagtttacttactgtctagcgtagtattgtagaacgtcctccgcttcgtacgtttcggggacggtacggggaccggtcgggtaggagtacgttacgacgaacggaacgttggttcggctgcctaaccgtattcgtaacgttcgttaaccc

SEQ ID NO: 408438 - DNA, 583 bp, Homo sapiens
  misc_feature: GZ8MTXP01AMGOX.11.11.A11.1.454.CMB.2.raw
  modified_base (209)..(209): a, c, t, g, unknown or other
  modified_base (403)..(403): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttanatagtgtacaacgataaggacttatttagcttggtatcagacaaaaaccaggacacgcctacctaaactgctcatcctccgtgggcagtccgtaccccgggcaccccggtatcccctagaccgtattcgagtggcacggcggggtctggggacagtaacttcaactctcaccatcacgcaaacctcgcgacggntagaagagtagtggacttagtttagttactgtcagtgtagtattgtagacgtccgtcgtctaccgtacgtttccggacggggtacgggaccggggtcggtaggacgacgttacggacggtaacggttacgttcggttcggtaaccgtacggtccctacgtacgttcgttcgttccttccg

SEQ ID NO: 408439 - DNA, 591 bp, Homo sapiens
  misc_feature: GZ8MTXP01AWI68.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaaacgataaggacttattagcttggtatcagacaaaaccaggacagcctactaaactgctcatcctccgtgggcagtccgtaaccgggcacccgggacgtccctgaccgattcgaggtcggcgacggcgggtcgtggggacagtaacttcaactctccaccactcacgcaacctgcgacggctagaagtagtggtaggtcttagtttacttacgtgtacagtcgtagttagttcgacggtaacgtccgtaccgtccttaccgtacggtttccggggaccgggacggggtacccgggcgggttacgggagtacgttcgaacggacgttaacgttggttacggtctcggcctacgtagttctcgttcgtttaacc

SEQ ID NO: 408440 - DNA, 632 bp, Homo sapiens
  misc_feature: GZ8MTXP01CZ5K2.11.11.A11.1.454.CMB.2.raw
  modified_base (361)..(361): a, c, t, g, unknown or other
  modified_base (373)..(373): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagaggccacatcgagtgcaagtccagcgagacttcttttatatagtgtacaacgataaggtactatttagcttggtatcagacaaaacaggacagcctacctaaactgctcatctcctgggcatcccgtacccgggcaccccggatccccgtagaccgattcaggtggcacggcggtcgtgggacagtaaccttcnctctacacctancgagccaacctgacgaacggtctagaaacgtgtggtcggtacttaagttttataccgtgtacgagtacggtaagttagttcgtacgaacgtccttacccgtctttaccggtacggtttcccggggacgggggtaacggggtccccggtaaggggttgggaaacggttacgttaccggtaaacggaaccgttaaaccgttggggcggtaaccgttccgaaccgtacctacgtttccgttaacggtttccccgtttaaccg

SEQ ID NO: 408441 - DNA, 547 bp, Homo sapiens
  misc_feature: GZ8MTXP01AQQDV.11.11.A11.1.454.CMB.2.raw
  modified_base (367)..(367): a, c, t, g, unknown or other
  modified_base (399)..(399): a, c, t, g, unknown or other
  modified_base (474)..(474): a, c, t, g, unknown or other
  modified_base (529)..(529): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttatatagtgtcaaacgataaggacttattagcttggtatcagacaaaaaccaggacagcctacctaaactgctcatctcctgggcactccgtaccccgggcaccccggagtccctgaccgtattcagtggcgaggcgggtctgggacagaaccttcaactcncaccatcacgcaacctgcaggctagaagatgnggtactagtttatacgtgtcgagcgtagttattgagagcctcgtctactacggtttcgggacgggaggggcccgnggggtggagtagttcgaaggaccgttaacgttggttacgggctcggcctaacctnttccgttcgttcctaacg

SEQ ID NO: 408442 - DNA, 616 bp, Homo sapiens
  misc_feature: GZ8MTXP01BR4ZI.11.11.A11.1.454.CMB.2.raw
  modified_base (601)..(601): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagagggccaccatcgagtgcaagtccagcgagtacttcttttatatagtgtacaacgataaggacttattagcttggtatcagacaaaacaggacagcctactaaactgctcactctccgtgggcactcccgtaccccgggccaccccggtacgtccccgtgaccgtattcgaggtcggcgacggccggggtcgtaggggaaccacggtaaccttcaacctcctacccaaccctactaccgacgaccaaacccgtcgaccgaagggccttaggaaagtgttaggtacggtacttaaggtttattacgtgtacgacgtacggtagttagttgtacgaacgtcctccgcttaccgtacgtttccggggacgggtacgggacccggtgggtaggagtacgttcgaacggtacgttacgttggttacgctcgctacgtnttctcgttcttaacc

SEQ ID NO: 408443 - DNA, 709 bp, Homo sapiens
  misc_feature: GZ8MTXP01AW5LO.11.11.A11.1.454.CMB.2.raw
  modified_base (676)..(676): a, c, t, g, unknown or other
tcagcgagagataccacgaccggtgctcgatttagctacgactgcaggggcagcaagatggtgttgcagacccaggtcttcatttctctgttgctctggatctctggtgcctggtggggacatcctgatcgacccacgtccccagatactcctgcctgtgtctcgtgggcgaggacgggccaccatcgagtgacaagtccagcgagtactttcttttatatagtgtacaaagataaggtacttattagtcttaggtatacaacgaacaaaaccaggacacgtccctacctaaactcgctcactcctccgtcgggacctacgtaccccggtaccccgggacccgaccccgggtacgtccccgtacggtaacccgtacgttacgacgggtcgggacgtacccggggtccggggttacggtacggggtaacctacggttaacccttacctaaccctaccctaccgaaaccctaccgtaccgaaccggaccctaaacccgtggaccgtaacgggacgtaggaaacgttgtacggtagttaccgtttaacgtttataccgttgtacgtaagtacgttagttagtttacgaacgtacctccgttccgtcgttaccgtacgggttcggggacgggtacggccggtggtaggacgtacgacgaacgacgttacgttggaccgtntcgcctaacgttcttcgtttcttaaccgttccg

SEQ ID NO: 408444 - DNA, 600 bp, Homo sapiens
  misc_feature: GZ8MTXP01BPNA5.11.11.A11.1.454.CMB.2.raw
  modified_base (399)..(399): a, c, t, g, unknown or other
  modified_base (537)..(537): a, c, t, g, unknown or other
tcagcgagagataccacgaccggtgctcgatttagctacgactgcaggggcagcaagatggtgttgcagacccaggtcttcatttctctgttgctctggatctctggtgcctggtggggacatcctgatcgacccagtccccagatatcctgcctgtgtctcgtgggcgagacgggccaccatcgagtgacaagtccagcgagtacttacttttatatagtgtacaaacgataaggtacttattagcttaggtatacaagaacaaaacaggacacgcctacctaaatgactctatctcgtgggacacgtcccgtaccccgggaccaccccgggacgtccctacggaccgtattccgaggtcggacgacggcgggtacgtcgggaacacgtaaccttacnctctaccaccactacacgacaaccgtgaccgaggctaggaagtagtggtaggacttagtttactacgtgtacgaggtatagttagtgtacgaacgtccgtacgctacgtacggttcggggacgggacgggtaccgggnggtaggagtacgacgaacggtacgttacgttggcgtctcgaacctactcttcgtcttccgtcg

SEQ ID NO: 408445 - DNA, 526 bp, Homo sapiens
  misc_feature: GZ8MTXP01CVOZL.11.11.A11.1.454.CMB.2.raw
  modified_base (310)..(310): a, c, t, g, unknown or other
  modified_base (340)..(340): a, c, t, g, unknown or other
  modified_base (355)..(355): a, c, t, g, unknown or other
  modified_base (418)..(418): a, c, t, g, unknown or other
  modified_base (430)..(430): a, c, t, g, unknown or other
  modified_base (496)..(496): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaacgataaggactatttagcttggtatcagacaaaaaccaggacagcctactaaactgctcatctcctggcatcctacccgggcaccccggngtccctgaccgattcagtggcacgcgggtntgggacagaacttcnctctcaccatcagcaacctgcaggctgaagatgtgatgtttatactgtcagcgtagttattgngaagtccgtccncgttccacgtttcgggcgggacgggccggcgggtggagattacgagtaacgaacgttggttacggntcggcaccgtattccgttgttctttaaccg

SEQ ID NO: 408446 - DNA, 628 bp, Homo sapiens
  misc_feature: GZ8MTXP01BUM2E.11.11.A11.1.454.CMB.2.raw
  modified_base (363)..(363): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttctttatatagtgtacaacgataaggactattagcttggatcagacaaaacaggacagcctacctaaatgctcactctccgtgggcactccgtacccgggccaccccggagtcccctagaccgattcgagtcggcacggcgggtctggggacagtaccttcnctctcaccatcacgcaaccgtgacgacggactaggaaattagttcgggtgggtacttaaggttttacttactcggtacacgtcgtaagtttagttggtacgtaaacgtccgtcccggtcttaccggttaccgtttccgggggacggggtaaccggggcccgggtcggggttacgggaacgtagttacgaacgggtaaccggaacggttggttacggggtcccttagggccctaaccctagttccggttgtttcccgtttaacccg

SEQ ID NO: 408447 - DNA, 602 bp, Homo sapiens
  misc_feature: GZ8MTXP01APNE8.11.11.A11.1.454.CMB.2.raw
  modified_base (375)..(375): a, c, t, g, unknown or other
  modified_base (515)..(515): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagtacttcttttatatagtgtacaaacgataaggacttatttagcttaggtatcaagacaaaaacaggacagcctacctaaatgctcatctccgtggcatcccgtacccggacaccccggtctccctagaccgtattcgagtcggcgacggtcgggtcgtaggggaccaggtaaccttcncctctaccaccactaccgacgaccaaaccctgacgaggctaggaaacgtgttaggtcggtacttaaggtttactacgtgtacagcgtaagttattgtagaacgtcctccgcttaccgtcgttcgggacggaacgggccgngggtacggagtacgttacgaaacggtacgttaacgttgggttcgtcctggaacccgtacctagttcctttcgttcccgtttaacccg

SEQ ID NO: 408448 - DNA, 815 bp, Homo sapiens
  misc_feature: GZ8MTXP01CPA8D.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctggtgggacatcctgatcgacccacgtccccagatatcctgcctgtgtctcgtgggcgaggacgggccaccatcgagtgacaagtccagcgtaagtactttactttttaataagtagtacgtaacaaacgtaagttaaacgggtaactttaagtttagtactttaggtaatacaacgaaaccaaaaaccgaggacacgtaccctaacctaaactcgacctacacttcctccgtcgggacctaccgtacccgtacccccggggaccccgtaccccgggtaccgttacccccgtacggaacccgtagtttaccggaggttcggaccggtacccggggtccggggttacgtacggggtaacgtaaccgtaaccctttacctaaccctcctacccaaacccgtactaccgaaccggaccctaaaccgtcgaccgacggtacgtaaggaagtaggttagggttacgtaaccgtttaagttttaacttacgttacgtacgtacgtaacgtttaaggtttacgtttaggtaaccgtaaccgttcccttacccgggtccgtttaaccggtaacccgggttttccgggggaccggggtaaccgggggtaccggtaacggggttaagacggttacgaccggaaacggtaacgttacggttcggttacgtaaccgacgtcccttacggtacttcgttaacgttccgtttaacccg

SEQ ID NO: 408449 - DNA, 642 bp, Homo sapiens
  misc_feature: GZ8MTXP01BGY53.11.11.A11.1.454.CMB.2.raw
  modified_base (371)..(371): a, c, t, g, unknown or other
  modified_base (592)..(592): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagtacttcttttatatagtgtacaaacgataaggtactatttagcttaggtatacagaacaaaaaccaggacagacctacctaaactgactcatctccgtggcacgtcccgtaccccggggccaccccgggacgtcccctagaccgtattcgaggttcggcgacggtcggggtacngggaaccacggtaaccttccaacctcctaccaaccctactccgaacgaccctaaaccctggacctaagggccttaggaaagtagttacgggtaggttaccttaaggttttaacttacgttgttacaaggtcgtaagtttagttacgtagtaacggtccttccggaacttccgtaacggtttccgggggacgggtaccgggcgggtcggttaaggaggtacncgaaagtaccgagttggttacgctgtcaccctattcgtcgttcgttaacc

SEQ ID NO: 408450 - DNA, 550 bp, Homo sapiens
  misc_feature: GZ8MTXP01B3TOH.11.11.A11.1.454.CMB.2.raw
  modified_base (342)..(342): a, c, t, g, unknown or other
  modified_base (357)..(357): a, c, t, g, unknown or other
  modified_base (537)..(537): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttatatagtgtcaaacgataaggactatttagcttggtatcagacaaaaaccaggacagcctacctaaactgctcatctcctgggcatccgtaccccggcacccggagtccctgaccgattcagtggcacggcgggtntgggacagaacttcnctctcaccatcacgcaaaccctgcgaggctagaagtatgtggctagtttatactgtacagcgtagttaagttggtagtaacggtccttccgcgttaccgtaacgtttccggggacgggtacggggaccgtcggggtagaggacttacgaagaccgttaagttggagggcctggccacgtnttctcgttcttcc

SEQ ID NO: 408451 - DNA, 824 bp, Homo sapiens
  misc_feature: GZ8MTXP01AF7SP.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagagggccaccatcgagtgcaagtccagcgagtacttcttttatatagtgtacaaacgataaggacttatttagcttggtatcaagacaaaaaccaggacacgcctacctaaactcgctcatctccgtgggcacgtcccgtaccccgggaccaccccgggacgtccccgtaggaacccgtagtttaccgaagggttcgggaccgtaacggggtccgggggttacgttacggggggaaacctaacgggttaaacccctttacctaacccgtttcccgtaacccctaaaccccgtaactttaccccgaaaccgggtaaccccaaaaccccgttcgggaacccgaacggggtacccgtttaaggggaaaacgggttacgttaggggttacggggttaacctttaaagggttttttaaacttaacccggttagttaccgtaacggtacgttaaggtttaacggtttggtaacggtaaacgtcccgttacccggtccgtttaccggttacccggttttccgggggaccggggtaaccggggtacccggggtaaccgggttaaggggacgtaacgttacggaaacgggtaaccgttaacggttcgggttacgggcgttacggcccgtaacctacgttaccggtttcgttaacccgtttaacccg

SEQ ID NO: 408452 - DNA, 542 bp, Homo sapiens
  misc_feature: GZ8MTXP01D45ML.11.11.A11.1.454.CMB.2.raw
  modified_base (338)..(338): a, c, t, g, unknown or other
  modified_base (352)..(352): a, c, t, g, unknown or other
  modified_base (408)..(408): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagacttcttttatatagtgtacaacgataaggactattagcttgtatcagacaaaaaccaggacagcctacctaaactgctcatctcctgggcatccgtacccggcaccccggatccctgaccgattcagtgcacgcggtntgggacagtactcnctctcaccatcagcaactgcagctagaagatgtgctagtttattacgtgtacacgngtaagttattgtacgaacgtccgtccgtcttacctaacggtttcgggacgggtaacggggccggcgggttaggagtacgttcgaaggacgttaacgttggttacggcttggcacccagttcttgttctttaacc

SEQ ID NO: 408453 - DNA, 608 bp, Homo sapiens
  misc_feature: GZ8MTXP01DVHPZ.11.11.A11.1.454.CMB.2.raw
  modified_base (254)..(254): a, c, t, g, unknown or other
  modified_base (355)..(355): a, c, t, g, unknown or other
  modified_base (517)..(517): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtcccagatatcctgcctgtgtctcgtgggcgagagggccaccatcgagtgcaagtccagcgagtacttcttttatatagtgtacaacgataaggactattagcttgtatcagacaaaacnggacagcctactaaactgctcatctcgtggcagtcccgtacccggcacccggtactccccgtagaccgtattcagtgcgacgcggtctggacagtacttcnctctcacatcagaccaacctgacgaggtctagtaaattagtacggtacggtacttaaggtttacttacgttgttacacgtacgttaagtttatttggtacgtaaacggtccctaccggttcttacccgttaccggtttcggggccgggtaacgggtcccggngggttagagtacgttacgaaggtaacgttaaccgttggttacgggcttcggaacctaaccctttacgttccgttaacgttccgtttaaccg

SEQ ID NO: 408454 - DNA, 724 bp, Homo sapiens
  misc_feature: GZ8MTXP01ATO9U.11.11.A11.1.454.CMB.2.raw
  modified_base (264)..(264): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagacttcttttatatagtgtacaaacgataaggacttatttagctttaggtatcaagacaaaaaccnggacagccctacctaaactgctcatctccgtgggcactccgtaccccgggcaccccgggtactcccaggaccgtattcgaaggttcggaccgacggtccggggtctacgggggaaccacggtaaccttccgaacttccctaccaacccaacgtccaaggaccctaaaccctgggaccaacgggtcctaagggaaacgtaggtttacgggtacgggtacgtttaaagttttaacgttaccgttaggtacctaagggtccggttaaaggtttagtttacgggtacgtaaaccggtccccttaccgggtcctttacccggtaaccgggttttcccgggggaccggggttaccgggggaccccgggtaacgggtagggaacggtacgttacggaaacgggtacgttaacccggttgggttacggtccgtacggtccacccgtagttcgttcgttctttaacccg

SEQ ID NO: 408455 - DNA, 600 bp, Homo sapiens
  misc_feature: GZ8MTXP01CHWCZ.11.11.A11.1.454.CMB.2.raw
  modified_base (271)..(271): a, c, t, g, unknown or other
  modified_base (359)..(359): a, c, t, g, unknown or other
  modified_base (364)..(364): a, c, t, g, unknown or other
  modified_base (373)..(373): a, c, t, g, unknown or other
  modified_base (531)..(531): a, c, t, g, unknown or other
  modified_base (540)..(540): a, c, t, g, unknown or other
tcagcgagagataccacgaccggtgctcgatttagctacgactgcaggggcagcaagatggtgttgcagacccaggtcttcatttctctgttgctctggatctctggtgcctggtgggacatcctgatgacccagtccccagatatcctgcctgtgtctcgtgggcgagagggccaccatcgagtgacaagtccagcgagtacttcttttaatatagtgtacaaacgtataaaggtacttattagcgttaggtatcaagaacaaaaaccgnggaacacgtcctacctaaactgctctatcctcgtggcatccgtacccgggcacccggctcccgtgacgtattcgagtgcgacgcggtnggacngtaacttcnctctccacactcacgtacaaccgtgacgaggctaaggaagtagtggtacggatttaaggtttacttacgtagtacgacgtaacgtaggtttaagtttcggaacgtaacgtcccgtacccgtcgttaccgtacgttccgggggacggtacgggacccgnggtaggacngttaccgaagtcgttaacgttggacggtcacgtccaacgtcttacgtcgttccttaaccg

SEQ ID NO: 408456 - DNA, 639 bp, Homo sapiens
  misc_feature: GZ8MTXP01E0PHA.11.11.A11.1.454.CMB.2.raw
  modified_base (262)..(262): a, c, t, g, unknown or other
  modified_base (290)..(290): a, c, t, g, unknown or other
  modified_base (356)..(356): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagacttcttttatatagtgtacaaacgataaggtacttatttagcttaggtatcagacaaaaccnggacagcctactaaactgctcatctcgnggcacgtcgtaccccggcaccccggacgtccccgtgaccgtattcgagtcggcgacggccggggtntacggggacacgtaacctttccaaccttcctacacccatccgacgaccaaacctgacgaggctagaagtagtggtcggtactagtttaatctgtacagacgtagttagttgtagaacgtcctccggtcttaccgtacgtttccggggaccggggtaacgggcccgggtaacggggttacggaacgtacggttacccgaaacgggtaaccgttaaaccgttcgggttacgggtcccgtacggaacccctaaaccccgttcgttccgttaaccgtttccgttccg

SEQ ID NO: 408457 - DNA, 582 bp, Homo sapiens
  misc_feature: GZ8MTXP01CQAKZ.11.11.A11.1.454.CMB.2.raw
  modified_base (448)..(448): a, c, t, g, unknown or other
tcagcgagagataccacgaccggtgctcgatttagctacgactgcaggggcagcaagatggtgttgcagacccaggtcttcatttctctgttgctctggatctctggtgcctggtggggacatcctgatgacccagtccccagatatcctgcctgtgtctcgtgggcgagacgggccaccatcgagtgcaagtccagcgagacttcttttatatagtgtacaaacgataaggactatttagcttggtatcaagacaaaaacgaggacagcctactaaaactgctcatctcctgggacagtccgtaccccgggcaccccggagtcccctagaccgtattccgagtggcgacggcgggtactggggaacagtaaccttcaacctctaccaaccactacacgacaaactgacagctagaagtagtgtggacttagttatacttgactacgngtaagttagttagagaacgtcctccgtctacgtacgtttcgggacgggtacgggcccgtgggtaggacgtagttaccgaaaggtacgaacgttggttacggctacggcaacccgttcttcgttcgttcttaacg

SEQ ID NO: 408458 - DNA, 689 bp, Homo sapiens
  misc_feature: GZ8MTXP01DPR7K.11.11.A11.1.454.CMB.2.raw
  modified_base (206)..(206): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagacgggccaccatcgagtgcaagtccagcgagtaccttnttttatatagtgtacaaacgtataaaggtacttattagcttaggtatcaagaacaaaaccgagacacgcctactaaactgctacactcctcgtgggactacgtcccggtaaccccggccgtacccggacgtccccgtagacccgtattccgaggtcggacacgggtcggggtacgtacggggactacgtaacccttacctcctcctacccaacctactaccgaacgtaccctaacccgtgacccgtagggtactaaggaaagttaagtcgggttacggttaacctttaaggtttacttaaccgttgtacgtacgtacggttaagttagttaggagacgtccgtccgtccgttacgtacggttccgggacgggtaacgggcccggtaagggtaggagtcgttaaacgtacggtaacccgttagttcggaccgggtaacttccggaacccttacgtgttacccgttcgttcccgttttaaccccg

SEQ ID NO: 408459 - DNA, 662 bp, Homo sapiens
  misc_feature: GZ8MTXP01ELOV8.11.11.A11.1.454.CMB.2.raw
  modified_base (398)..(398): a, c, t, g, unknown or other
tcagcgagagataccacgaccggtgctcgatttagctacgactgcaggggcagcaagatggtgttgcagacccaggtcttcatttctctgttgctctggatctctggtgcctggtgggacatcctgatcgacccagtccccagatatcctgcctgtgtctcgtgggcgaggacgggcccaccatcgagtgacaagtccagcgagtacttcttttatatagtgtacaaacgtataaaggtacttatttagcttaggtatacaagaacaaaaacaggacacgacctacctaaactgactcacttctccgtgggccacgtcccgtaccccgggccaccccggacgtcccctacgaccgtattcgaggtcggcgacggcgggtcgtgggacagtaaccttcnctctaccaccactacacgacaacctgacgaggtctagtaattagtggtacggtacttaagtttatacgtaggtacaggtctaagttagttgacgtaacgtcccgtccgtcgttaccgtaccgtttccgggggaccggggtaaccggggtaccccgggtcgggttaagggaacgtacgttaccggaaacggtaaccggttaaccggttgggttccggtccgtacggaacccgttacctacggttcttccgtttccgtttaacccg

SEQ ID NO: 408460 - DNA, 629 bp, Homo sapiens
  misc_feature: GZ8MTXP01AW585.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctggtgggacatcctgatcgacccagtccccagatatcctgcctgtgtctcgtgggcgagacgggccaccatcgagtgacaagtccagcgagtacttctttatatagtgtacaaagataaggacttattagcttggtatcaagacaaaacaggacacgcctacctaaactgctctactctccgtggccacgtcccgtaccccgggctaccccggggactccccgtagaccgtattcgaggtcggccacggggtccggggtcgtacgggacctacgtaaccttacctaacctcctaccaacccatccgaacgtccaaacccgtgacgacgggtactaggaaagtgtacggtcggtacgttagttttactactcggtaccgagtacggtagttagttgtacgaacgtccgttacccgcgttacgtaccggttccggggacggggtaaccgggccgaacggggtaggatacgttcgaacggtacgacgttggacggtctacgcacagttctcgttcctaacg

SEQ ID NO: 408461 - DNA, 537 bp, Homo sapiens
  misc_feature: GZ8MTXP01D8MVZ.11.11.A11.1.454.CMB.2.raw
  modified_base (259)..(259): a, c, t, g, unknown or other
  modified_base (355)..(355): a, c, t, g, unknown or other
  modified_base (410)..(410): a, c, t, g, unknown or other
  modified_base (470)..(470): a, c, t, g, unknown or other
  modified_base (521)..(521): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagagggccaccatcgagtgcaagtccagcgagacttcttttatatagtgtacaaacgataaggtacttattagcttggtatcagacaaaaacnggacagcctactaaatgctcatctcctgggcatccgtacccgggcacccggatcccctgaccgattcagtgcacggcggtctgggacagaacttcnctctcaccatcagcaacctgctagctgaagatgtgtctagttatactgtacacgntaagttattgtacgtaacgcctccgtctaccgtacgtttcggggacggtacggggcccgngggttaggagtacgttacgaggacgttaacgttggttcgcgtcgcaacgtnttctcgttccttaacc

SEQ ID NO: 408462 - DNA, 669 bp, Homo sapiens
  misc_feature: GZ8MTXP01CQ0WQ.11.11.A11.1.454.CMB.2.raw
  modified_base (330)..(330): a, c, t, g, unknown or other
tcagcgagagataccacgaccggtgctcgatttagctacgactgcaggggcagcaagatggtgttgcagacccaggtcttcatttctctgttgctctggatctctggtgcctggtggggacatcctgatcgacccagtccccagatatcctgcctgtgtctcgtgggcgagaggccatcatcgagtgacaagtccagcgagtacttcttttaatatagtgtacaaacgtataaggacttatttagcttggtatacagacaaaacgagacacgcctacctaaactgactcatcctcgtggacacgtccgtaccccggcacccggacgtccngaccgattcaggtcggccacggcggtctaggggacaacgtacttcaacttccctaccaccactaccgacgaccctaacccgtgaccgacggggtactaaggtaaacgaagttggggttacgggtaccttaaaggttttttaacttaacgttcggttacgaacgggggtacttaaggtttagtttacggcggtaaacgtccccgttaacccggtccttaccggtaccggtttaccgggggccgggtaaaccggggccggtacggggttaggaagacgttaccggagttaacggttacgttcgggtgaccgtcgacctaccttattcccgttgtttaaccc

SEQ ID NO: 408463 - DNA, 677 bp, Homo sapiens
  misc_feature: GZ8MTXP01EJ7G1.11.11.A11.1.454.CMB.2.raw
  modified_base (292)..(292): a, c, t, g, unknown or other
  modified_base (400)..(400): a, c, t, g, unknown or other
tcagcgagagataccacgaccggtgctcgatttagctacgactgcaggggcagcaagatggtgttgcagacccaggtcttcatttctctgttgctctggatctctggtgcctggtggggacatcctgatcgacccagtccccagatatcctgcctgtgtctcgtgggcgagacgggccaccatcgagtgcaagtccagcgagtacttcttttatatagtgtacaacgtaataaggtacttatttagcttaggtatcaagaacaaaaaccgaggaacacgccctacctaaacngctcatcctcctgggactagtcccgtaccccgggcgaccccgggtactccccgtagaccgtattcgaggtcggacgacggcggggtctagggacacgtaacccttacnccttcctaccgacctactaccgaacggtccctaaacccgtgcccgtaaggtaccgtaaggaaacgtagtttagggtacgggtactttaacggttttattaccgtggttaaccagtacggtaagtttagtttaggacgtaacggtccctccggtcttaccggtacggttccggggaccgggacgggggtcggaacggggttggagacgttacgaaacggtacttaacggttggggttccaacgtcgaaccctaacggcttcgttcgttccgtttaacc

SEQ ID NO: 408464 - DNA, 579 bp, Homo sapiens
  misc_feature: GZ8MTXP01AQ3UG.11.11.A11.1.454.CMB.2.raw
  modified_base (325)..(325): a, c, t, g, unknown or other
  modified_base (515)..(515): a, c, t, g, unknown or other
  modified_base (566)..(566): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagtacttcttttatatagtgtacaaacgataaggacttatttagcttggtatcagacaaaaccaggacagcctactaaactgctcatctccgtgggcactccgtaccccgggcaccccggagtccccngaccgtattcgaggtggcacggccgggtgtgggacagtaaccttcaactctacaccatcacgaccaaacctagaggctagaagtagtggtacggacttaaggtttatacgtgtacagtactaaggttatttgaacgtacgtcctcccgtcgtaccgttaccggttcggggaccggggtacgggacccggngggtaaggaagttacgtaccgaggaaccgtagttggttgctgctaaccgtntcttctcttcgtc

SEQ ID NO: 408465 - DNA, 586 bp, Homo sapiens
  misc_feature: GZ8MTXP01EN0LE.11.11.A11.1.454.CMB.2.raw
  modified_base (567)..(567): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagacttcttttatatagtgtacaacgagtaaggacttattagcttggtatcaagacaaaaaccaggacagcctacctaaactgctcatctccgtgggcactccgtaccccggcacccggagtcccctgaccgattcagtggcacggcgggtctgggacagtaaccttcaactctaccaccatcacgcaaaccgtgacgaggctagaagagttcggtgggtactagtttacttacgtgttcgagtacgtaagttgttaggtacggaagtcccgtaccgtctacgtaccggtttcggggacgggtacggggccggtcgggttaggagtacgttcgaaggtaaccgttaagttggttcggcttaggcctaacngttccgtcgtttccttccg

SEQ ID NO: 408466 - DNA, 717 bp, Homo sapiens
  misc_feature: GZ8MTXP01AYKNJ.11.11.A11.1.454.CMB.2.raw
  modified_base (217)..(217): a, c, t, g, unknown or other
  modified_base (266)..(266): a, c, t, g, unknown or other
  modified_base (411)..(411): a, c, t, g, unknown or other
tcagcgagagataccacgaccggtgctcgatttagctacgactgcaggggcagcaagatggtgttgcagacccaggtcttcatttctctgttgctctggatctctggtgcctggtggggacatcctgatcgacccagtccccagatatcctgcctgtcgtctcgtgggcgaggacgggccaccatcgagtgacaagtccagcgagtacttctttaanatagtgtacaaacgataaggacttattagcttggatcaagacaaaacgngacacgcctactaaacgtcgctacatccgtccgtcgggacctacgtaccgtaccccgggccgaccccgggtacgtcccctacggaaccgtattcgaggtcggacgacgggtcgggtacgtacggggacctacggtaaccttaccnctcctaccaaccataccgacgacctaaaccgtcgacgtaacgggaccttagaaacgttgttacgggtagggttaaccttaagttttaacgttacgtaggtaaccgagggttacgtaaaggtttacgtttagggaaccgtaaacgtcccgtacccgtaccgttaccggttaaccgggttccgggggaaaccggggtacgggggtccggtaacggggtagggaccgtaacgttacccgaagggtaaccgttacggttacgggttcggaactacggtccctaaccgtggttccttcgttaaccgttccc

SEQ ID NO: 408467 - DNA, 494 bp, Homo sapiens
  misc_feature: GZ8MTXP01A3BH9.11.11.A11.1.454.CMB.2.raw
  modified_base (355)..(355): a, c, t, g, unknown or other
  modified_base (371)..(372): a, c, t, g, unknown or other
  modified_base (376)..(376): a, c, t, g, unknown or other
  modified_base (386)..(386): a, c, t, g, unknown or other
  modified_base (396)..(396): a, c, t, g, unknown or other
  modified_base (398)..(398): a, c, t, g, unknown or other
  modified_base (400)..(400): a, c, t, g, unknown or other
  modified_base (447)..(447): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctctaaaactgctcatctcctgggcatctaccccggcaccccggatccctgaccgattcagtgcagcgggtctgggacagaacttcaactcncaccatcagcaacccnngagnagagatgtgntattattatntnanagagtagtagtagacgctccgctctcgttcggcggacgggcggcggnggagtagacgagaacgacgttgttgctcgcactattactcgttcgtc

SEQ ID NO: 408468 - DNA, 562 bp, Homo sapiens
  misc_feature: GZ8MTXP01CX9TL.11.11.A11.1.454.CMB.2.raw
  modified_base (207)..(207): a, c, t, g, unknown or other
  modified_base (393)..(393): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagaggccaccatcgagtgcaagtccagcgagactcttttanatagtgtacaaacgataaggactatttagcttaggtatcagacaaaaaccaggacagcctctaaaactgctcatctcctgggcaatctacccgggcaccccggagtccctgaccgattcagtggcacgcgggtctggggacagaacttcaactctcaaccatcagcaaaccctgcaggctgaaagntgtgatagtttatactgacagactagtattgagaacgtcctccgtctaccgtacgtttccggggacgggacggggacccggcggggtaaggacgtacgttacgaaacgggaacgaaacgttcgggttcggtaacctcggaacccaccttagtttccgtcggtttcctcc

SEQ ID NO: 408469 - DNA, 751 bp, Homo sapiens
  misc_feature: GZ8MTXP01BBJF6.11.11.A11.1.454.CMB.2.raw
  modified_base (215)..(215): a, c, t, g, unknown or other
  modified_base (221)..(221): a, c, t, g, unknown or other
tcagcgagagataccacgaccggtgctcgatttagctacgactgcaggggcagcaagatggtgttgcagacccaggtcttcatttctctgttgctctggatctctggtgcctggtgggacatcctgatcgacccagtccccagatatcctgcctgtgtctcgtgggcgaggacgggccaccagtcgagtgacaagtccagcgagtacttctttanatagtntacaagtataaggtacttattagtcttagtatacgagaaccaaaacgaggacacgtacccttacctaaactcgacctactacttcctccgtggggtacctacgttaccccggtacccccggggaccctaacccccgggtacgtcccccgtaggtacccgtattaccgaggttcgggaccgtaccggggtccggggtacgtacgggggaaacctacggtaacccttaccgtaacccttcctaacccaaccctaacttaccgaacggacctaacccgtacgacgaacggtctaaggaacgtgttacggtaggtacgtttaagtttacttaccgtagtacgtagtagttaagttagttcggtaacgtaccgtcccgttaccggtaccttaccggttaccggttaccggggggaccggggtacggggtacccgggtaacgggtaggacgtacgttaacgacgggtaaccggttacggttggaccggtcgtaaccgtcccgtaaacggtcttaccgtcggtttccctttaacccg

SEQ ID NO: 408470 - DNA, 480 bp, Homo sapiens
  misc_feature: GZ8MTXP02GUNFP.11.11.A11.1.454.CMB.2.raw
  modified_base (206)..(206): a, c, t, g, unknown or other
  modified_base (342)..(342): a, c, t, g, unknown or other
tcagcgagagataccacgaccggtgctcgatttagctacgactgcagggcagcaagatggtgttgcagacccaggtattcatttctctgttgctctggatctctggtgcctgtgggacatcctgatgacccagtccccagatatcctgcctgtgtctctgggcgagagggccaccatcgagtgcaagtccagcgagactcttttanatagtgtcaacgataaggactattagcttggtatcagcaaaaccaggacagcctcctaaactgctcatctcctgggcatctacccggcacccggatccctgaccgattcagtggcagcggtctgggacagacttcnctctcaccatcagcaacctgcaggctgaagatgtggcagtttatactgtcagcagtattgtgaagctccgctcactttcggcggaggggaccgcgggtggagactcgaagacgaactgtagctgcaccatctgtcttc

SEQ ID NO: 408471 - DNA, 493 bp, Homo sapiens
  misc_feature: GZ8MTXP02J0H7Y.11.11.A11.1.454.CMB.2.raw
  modified_base (352)..(352): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaccaggacagcctacctaaactgctcatctcctgggcatcctacccgggcaccccggatccctgaccgattcagtggcagcgggtctggggacagacttcnctctcaccatcagcaacctgcaggctagaagatgtggctagtttatactgttagctagtattgtagaagctccgctcacgtttcggcggagggccgcggtggagatcgaagacgaactgtcgactgccacatctgtctctc

SEQ ID NO: 408472 - DNA, 486 bp, Homo sapiens
  misc_feature: GZ8MTXP02G4B4P.11.11.A11.1.454.CMB.2.raw
  modified_base (402)..(402): a, c, t, g, unknown or other
  modified_base (415)..(415): a, c, t, g, unknown or other
tcagcgagagataccacgaccggtgctcgatttagctacgactgcagggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagactcttttatatagtgtcaacgataaggactatttagcttggtatcagcaaaaccaggacagcctcctaaactgctcatctcctgggcatctacccggcacccggagtccctgaccgattcagtggcagcggtctgggacagacttcactctcaccatcagcaacctgcaggctagaagatgtggcagtttatactgtcagcagtntgtgaagctccgntcacgtttcggcggtaggaccgcggtggagacgtcaggacgaactgtaggctgcaccgatcgtcgtcttac

SEQ ID NO: 408473 - DNA, 493 bp, Homo sapiens
  misc_feature: GZ8MTXP02IUF56.11.11.A11.1.454.CMB.2.raw
  modified_base (253)..(253): a, c, t, g, unknown or other
  modified_base (416)..(416): a, c, t, g, unknown or other
tcagcgagagataccacgaccggtgctcgatttagctacgactgcagggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagactctttatatagtgtcaacgataaggactatttagcttggtatcagacaaaaaccnggacagcctacctaaactgctcatctcctgggcatctacccggcacccggagtccctgaccgatcagtgcagcggtctgggacagacttcactctcaccatcagcaaacctgcaggctgaagatgtggcagtttatactgtcagcagttatgtgaagctccgntcacgtttcggcggaagggcccggtcggtggagactacgacgacgtaacgtggtcgcgtcgacgacactctcgtctc

SEQ ID NO: 408474 - DNA, 484 bp, Homo sapiens
  misc_feature: GZ8MTXP02JYNDG.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctaccccggcacccggagtccctgaccgattcagtggcagcgggtctggggacagacttcactctcaccatcagcaacctgcaggctgaagatgtggctagtttattactgtcagcagtattgtgaagctccgcttcactttcggcggagggaccgcgggtgagctcagacgaactgtggctgcacatctgtcttc

SEQ ID NO: 408475 - DNA, 521 bp, Homo sapiens
  misc_feature: GZ8MTXP02HM64P.11.11.A11.1.454.CMB.2.raw
  modified_base (349)..(349): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactctttatatagtgtcaacgataaggactatttagcttggtatcagacaaaaaccaggacagcctcctaaactgctcatctcctgggcatctacccgggcacccggagtccctgaccgattcagtggcagcgggtctgggacagacttcnctctcaccatcagcaacctgcaggctagaagatgtggctagtttatactgtcagctagttattggtagaagcctccgctctacgtttcgggcgggagggacccggcgggtaggagacgtacgaacggacgtaacgtggtcggcgtcgacctacgtattcgttcgttacctcg

SEQ ID NO: 408476 - DNA, 497 bp, Homo sapiens
  misc_feature: GZ8MTXP02GAX2I.11.11.A11.1.454.CMB.2.raw
  modified_base (488)..(488): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagaggccaccatcgagtgcaagtccagcgagactcttttatatagtgtcaacgataaggactatttagcttggtatcagacaaaaccaggacagcctactaaactgctcatctcctgggcatcctacccggcacccggagtccctgaccgattccagtggcacggcggtctgggacagacttcactctacaccatcagcaacctgcaggctgaagatgtaggctagtttatactgtcagctagtattgtagaagcctccgctcgtacgtttcgggcgggacggccgcggtggagactcgagacgaactggtggctgacacctntctcgtctc

SEQ ID NO: 408477 - DNA, 488 bp, Homo sapiens
  misc_feature: GZ8MTXP02J2WLZ.11.11.A11.1.454.CMB.2.raw
  modified_base (206)..(206): a, c, t, g, unknown or other
  modified_base (349)..(349): a, c, t, g, unknown or other
  modified_base (380)..(380): a, c, t, g, unknown or other
  modified_base (396)..(396): a, c, t, g, unknown or other
  modified_base (470)..(470): a, c, t, g, unknown or other
  modified_base (480)..(480): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagactctttanatagtgtcaacgataaggactatttagcttggtatcagacaaaaaccaggacagcctacctaaactgctcatctcctgggcatctacccggcacccggatccctgaccgattcagtggcaggcgggtctggggacagacttcnctctcaccatcagcaacctgcaggctagaantgtgctagtttatacngtcagcagtattgtagaagctccgctcgcgtttcgggcggacgggaccgcgggtggagagtcgagacgaactgnggctgcactntctctctc

SEQ ID NO: 408478 - DNA, 560 bp, Homo sapiens
  misc_feature: GZ8MTXP02H5CDK.11.11.A11.1.454.CMB.2.raw
  modified_base (208)..(208): a, c, t, g, unknown or other
  modified_base (356)..(356): a, c, t, g, unknown or other
  modified_base (391)..(391): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccacatcgagtgcaagtccagcgagacttcttttanatagtgtacaacgataaggactatttagcttggtatcagacaaaaaccaggacagcctacctaaactgctcatctcctgggcatcctacccgggcacccggagtccctgaccgattccagtggcacggcgggtctggggacagcttcnctctacaccatcagcaaacctgacaggctgaaagngtgtgacttagttatactgtacagactagttatgagaacgtctaccgtcttacgtacggttcggggacgggtacggggaccggtacgggtaggagtactacggaacggtaaccgtacgttggtacggtccgtacggacctaccgtacgtttccgttcgtttacctaccg

SEQ ID NO: 408479 - DNA, 499 bp, Homo sapiens
  misc_feature: GZ8MTXP02HWUQ8.11.11.A11.1.454.CMB.2.raw
  modified_base (347)..(347): a, c, t, g, unknown or other
  modified_base (491)..(491): a, c, t, g, unknown or other
  modified_base (495)..(495): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactctttatatagtgtcaacgataaggactattagcttggtatcagcaaaaaccaggacagcctacctaaactgctcatctcctgggcatctaccccggcacccggagtccctgaccgattcagtggcagcggtctgggacagacttcnctctcaccatcagcaacctgcaggctgaagatgtggctagtttatactgtacagcagttattgtagaacgtctccgcttcgacgtttcggacgggtagggacccgtcgggtaggagactcgaagacgaactgtagcgtgcactntctntctc

SEQ ID NO: 408480 - DNA, 521 bp, Homo sapiens
  misc_feature: GZ8MTXP02F7YLH.11.11.A11.1.454.CMB.2.raw
  modified_base (207)..(207): a, c, t, g, unknown or other
  modified_base (255)..(255): a, c, t, g, unknown or other
  modified_base (349)..(349): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagactcttttanatagtgtcaacgataaggactatttagcttggtatcagacaaaaaccnggacagcctacctaaactgctcatctcctgggcatcctacccggcacccggatccctgaccgattcagtggcagcgggtctgggacagacttcnctctcacatcagcaactgcaggctagaagatgtggctagtttatactgtacagctagtattgtagaagtcctccgcttctacgtttcgggacgggtacggggacccgtcgggtggagtactacgaacgaccgaaacgtggtacggctcgaccacctatcttcgtctttaccg

SEQ ID NO: 408481 - DNA, 519 bp, Homo sapiens
  misc_feature: GZ8MTXP02IWOG3.11.11.A11.1.454.CMB.2.raw
  modified_base (352)..(352): a, c, t, g, unknown or other
  modified_base (505)..(505): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttctttatatagtgtcaacgataaggactatttagcttggtatcagacaaaaccaggacagcctcctaaactgctcatctcctgggcatcctaccccggcaccccggagtcccctgaccgattcagtggcaggcggtctgggacagacttcnctctcaccatcagcaacctgcaggctgaagatgtgctagtttatactgttcagcagttatgtagaacgctccgctcgtaacgtttcgggcggacgggacccgtcggggtcgaggtactcgaacggacgaaacttggtaggcgtgcctaacctnttcgttcgttctcg

SEQ ID NO: 408482 - DNA, 524 bp, Homo sapiens
  misc_feature: GZ8MTXP02JSYHC.11.11.A11.1.454.CMB.2.raw
  modified_base (309)..(309): a, c, t, g, unknown or other
  modified_base (379)..(379): a, c, t, g, unknown or other
  modified_base (382)..(382): a, c, t, g, unknown or other
  modified_base (423)..(423): a, c, t, g, unknown or other
  modified_base (454)..(454): a, c, t, g, unknown or other
  modified_base (504)..(504): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaccaggacagcctcctaaactgctcatctcctgggcatctacccggcacccggatcccngaccgattcagtggcagcgggtctgggacagacttcactctcaccatcagcaacctgccaggctagaagntgnggactagtttatactgtcagctagtattgtagaagctccgnttcgacgtttcgggacgggtacgggacccgngggtacggagactcgaacggacgaacgttggtcggccgtggacctaacgnttccgtcggttacctttccg

SEQ ID NO: 408483 - DNA, 493 bp, Homo sapiens
  misc_feature: GZ8MTXP02IQP4S.11.11.A11.1.454.CMB.2.raw
  modified_base (350)..(350): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggaacagcctacctaaactgctcatctcctgggcatctaccccggcacccggatccctgaccgattcagtggcagcgggtctgggacagacttcnctctcaccatcagcaacctgcaggctgaagatgtggctagtttatactgtcagtcagttattgtgaagcctcgctcactttcggacggaggaccgcggtggagatcaggacgaaacgtgtggcgtcgacacatcctgtctttc

SEQ ID NO: 408484 - DNA, 500 bp, Homo sapiens
  misc_feature: GZ8MTXP02IVLCL.11.11.A11.1.454.CMB.2.raw
  modified_base (255)..(255): a, c, t, g, unknown or other
  modified_base (334)..(334): a, c, t, g, unknown or other
  modified_base (348)..(348): a, c, t, g, unknown or other
  modified_base (423)..(423): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccnggacagcctacctaaactgctcatctcctgggcatctacccggcacccggatccctgaccgattcagtggcagcgggtntgggacagacttcnctctcaccatcagcaacctgcagctagaagatgtggactagtttatactgtacagcagttattgtgaagctccgntcacgtttcggacggtacggaccgcggtggagactcgaaggacgaactgtaggctgactaccgatctgtaccttacg

SEQ ID NO: 408485 - DNA, 519 bp, Homo sapiens
  misc_feature: GZ8MTXP02ISH8S.11.11.A11.1.454.CMB.2.raw
  modified_base (257)..(257): a, c, t, g, unknown or other
  modified_base (308)..(308): a, c, t, g, unknown or other
  modified_base (383)..(383): a, c, t, g, unknown or other
  modified_base (414)..(414): a, c, t, g, unknown or other
  modified_base (422)..(422): a, c, t, g, unknown or other
  modified_base (428)..(428): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgtctgtgtctctgggcgagagggccaccatcgagtgcaagtccagcgagacttcttttatatagtgtcaacgataaggactatttagcttggtatcagacaaaaaccnggaacagcctcctaaactgctcatctcctgggcatctacccggcacccggngtccctgaccattcagtggcaggcgggtctgggacagacttcactctcaccatcagcaaacctgcaggctagaanatgtggctagtttatactgtacagcaagttntgtagaanctccgntcgtacgttcgggacggtagggacccgtcgggtaggagactaccgaagacgtaaacgtggtaggcgtacgccaccattctacgttcttacc

SEQ ID NO: 408486 - DNA, 502 bp, Homo sapiens
  misc_feature: GZ8MTXP02FPKZT.11.11.A11.1.454.CMB.2.raw
  modified_base (347)..(347): a, c, t, g, unknown or other
  modified_base (381)..(381): a, c, t, g, unknown or other
  modified_base (493)..(493): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagactctttatatagtgtcaacgataaggactattagcttggtatcagacaaaaaccaggacagcctacctaaactgctcatctcctgggcatctacccggcacccggagtccctgaccgattcagtggcagcgggtctgggacagacttcnctctcaccatcagcaacctgcaggctgaagatgnggcagtttatactgtcagcagtattgtagaagcctcgctcgtacgtttcggcgggtagggacccgcgggtaggagactaccgaggaccgtaacgtggtggcgtcgacacctntctcgtctc

SEQ ID NO: 408487 - DNA, 493 bp, Homo sapiens
  misc_feature: GZ8MTXP02GANLP.11.11.A11.1.454.CMB.2.raw
  modified_base (208)..(208): a, c, t, g, unknown or other
  modified_base (379)..(379): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtcaacgataaggactatttagcttggtatcagacaaaaaccaggacagcctcctaaactgctcatctcctgggcatctacccgggcacccggatccctgaccgattcagtgcagcggtctgggacagacttcactctcacatcagcaactgcaggctgaagatgnggctagtttatactgtcagcagtattgagaagctcgctcgtacgtttcggacggagggacccgcgggtggagacgtcgaacgacgaactgtggccgtgcaccgatctgtcttac

SEQ ID NO: 408488 - DNA, 548 bp, Homo sapiens
  misc_feature: GZ8MTXP02GV8LD.11.11.A11.1.454.CMB.2.raw
  modified_base (354)..(354): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagactcttttatatagtgtcaacgataaggactatttagcttggtatcagacaaaaccaggacagcctacctaaactgctcatctcctgggcatccgtacccggcaccccggacgtcccctgaccgattcagtggcaggcgggtctgggacagacttcnctctcaccatcagccaacctgcaggctagaagatgtggctaagtttatacgtgtcagctagttattgtagaacgccgtccgctcgtacgtttcgggacgggtacggggaccggtcgggtaggagtacgtacgaacggacgtaacgtcggtaggccgtggaccctaaaccgtacgttccgttcgtttaccttacg

SEQ ID NO: 408489 - DNA, 541 bp, Homo sapiens
  misc_feature: GZ8MTXP02JF5LA.11.11.A11.1.454.CMB.2.raw
  modified_base (315)..(315): a, c, t, g, unknown or other
  modified_base (391)..(391): a, c, t, g, unknown or other
  modified_base (396)..(396): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaacgataaggactatttagcttggtatcagacaaaaaccaggacagcctacctaaactgctcatctcctgggcatctacccggcacccggagtcccngaccgattcgagtcggcacggcgggtctgggacagacttcactctacaccatcagccaacctgacaggctagaagngtagnggcttagtttatacgtgtcaggctagttattgtagaacgtcgtccgctcgtacgtttccggacgggtacgggacccgtcgggtaggacgtacgtacgaacggaccgtaacgtggtacggcgtgaccacgtactctcgttcttccg

SEQ ID NO: 408490 - DNA, 540 bp, Homo sapiens
  misc_feature: GZ8MTXP02F8ZB9.11.11.A11.1.454.CMB.2.raw
  modified_base (212)..(212): a, c, t, g, unknown or other
  modified_base (260)..(260): a, c, t, g, unknown or other
  modified_base (314)..(314): a, c, t, g, unknown or other
  modified_base (359)..(359): a, c, t, g, unknown or other
  modified_base (395)..(395): a, c, t, g, unknown or other
  modified_base (438)..(438): a, c, t, g, unknown or other
tcagcgagagataccacgaccggtgctcgatttagctacgactgcaggggcagcaagatggtgttgcagacccaggttcttcatttctctgttgctctggatctctggtgcctgtggggacattcctgatgaccctagtccccagatatcctgcctgtgtctctgggcgagagggccaccatcgaggtgcaagtccagcgagacttctttanatagtgtcaacgataaggactatttagcttggtatcagacaaaaaccnggacagcctacctaaactgctcatctcctgggcagtcgtacccgggcaccgggngtccctgaccgtattcagtggcagcgggtctgggacagtacttcnctcaccacatccgagccaaacctgcaaggctagaanctgtggactaagtttatacgtgtacagactagttatgtagaanccgtcgactcgtaacgtttcgggacggtacgggacccgtagggtaggaagacgtacgacggacgtaactggtagcgttacgacaccgtgtcgtcgtacttcg

SEQ ID NO: 408491 - DNA, 576 bp, Homo sapiens
  misc_feature: GZ8MTXP02G23K7.11.11.A11.1.454.CMB.2.raw
  modified_base (352)..(352): a, c, t, g, unknown or other
  modified_base (383)..(383): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggactatttagcttggtatcagcaaaacaggacagcctcctaaactgctcatctcctgggcatccgtaccccggcacccggagtcccctgaccgattcagtggcaggcgggtctgggacagacttcnctctcacatcagcaacctgcaggctagaagntaggtcggctagtttatactgtacagcgtagttattgtagtaacgccttccgcttcgtaccgtttcggggaccggggtacgggggacccgggtcgggttacgggaggtacgtacggaacgggtaaccggtaaaccggtgggttacgggccgttacggaccctacccgtattccgtttacggttaccttttccc

SEQ ID NO: 408492 - DNA, 512 bp, Homo sapiens
  misc_feature: GZ8MTXP02JAOVO.11.11.A11.1.454.CMB.2.raw
  modified_base (336)..(336): a, c, t, g, unknown or other
  modified_base (349)..(349): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagactctttatatagtgtcaacgataaggactatttagcttggtatcagacaaaaaccaggacagcctacctaaactgctcatctcctgggcatcctacccggcacccggagtccctgaccgattcagtggcagcgggtcngggacagacttcnctctcaccatcagcaacctgcaaagctagaagatgtgctagtttatactgtacagcagtattgtagaagtcctccgctcgtacgtttcggcggagggacccgcggtaggagacgtcgaacgacgtaaactggtacggctcggcaccgtatcgtcgtctttacg

SEQ ID NO: 408493 - DNA, 497 bp, Homo sapiens
  misc_feature: GZ8MTXP02JMXN6.11.11.A11.1.454.CMB.2.raw
  modified_base (209)..(209): a, c, t, g, unknown or other
  modified_base (386)..(386): a, c, t, g, unknown or other
  modified_base (415)..(415): a, c, t, g, unknown or other
  modified_base (420)..(420): a, c, t, g, unknown or other
  modified_base (427)..(427): a, c, t, g, unknown or other
  modified_base (462)..(462): a, c, t, g, unknown or other
  modified_base (488)..(488): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttanatagtgtcaacgataaggactatttagcttggtatcagacaaaaaccaggacagcctacctaaactgctcatctctgggcatctacccggcacccggagtccctgaccgattcagtggcacggcggtctgggacagacttcactctcaccatcagcaacctgcaggctagaagatgnggctaagtttatactgtcagcagttatgnggaanctaccgntcacgtttgggcggtaggaccgcgggtggagtacncgacgacgaacgttgaggctgccacntctcgtctc

SEQ ID NO: 408494 - DNA, 568 bp, Homo sapiens
  misc_feature: GZ8MTXP02IIJC6.11.11.A11.1.454.CMB.2.raw
  modified_base (547)..(547): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgaccccagtccccagatatcctgcctgtgtctctgggcgagagggccaccatcgagtgcaagtccagcgagacttctttatatagtgtcaaacgataaggacttattagcttggtatcagacaaaaaccaggacagcctacctaaactgctcactctcctgggcatccgtaccccggcaacccggactccctgaccgtattcgagtggcacggtcgggtcgtgggacagtacttcgactctcaccatcagcaactgcaggctagaagagtgtcggtactagtttaatacgtgtaccaggtactaagtttagtttaggtaggtaaacgtccgtaccggtccttacgttaaccggtttcgggacggggacggggtaaccggtcgggtagggtacgatacgaacgacgtaacgtgtcgcgtnaccacctagtctcgtacttcc

SEQ ID NO: 408495 - DNA, 516 bp, Homo sapiens
  misc_feature: GZ8MTXP02HL2X7.11.11.A11.1.454.CMB.2.raw
  modified_base (208)..(208): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttanatagtgtcaacgataaggactatttagcttggtatcagacaaaaccaggacagcctacctaaactgctcatctctggcatcctacccggcacccggatccctgaccgattcagtggcacggccgggtctgggacagacttcactctcaccatcagcaacctgcaggctgaagtatcgtggctaggttttatacgtgtacagcaagtttattgtagaagcctaccgctcgtacgtttcgggcgggacgggaccgcgggtaggagactacgagaacgtacgtggtggcctgaccacattctcgttacttc

SEQ ID NO: 408496 - DNA, 484 bp, Homo sapiens
  misc_feature: GZ8MTXP02F5BJ6.11.11.A11.1.454.CMB.2.raw
  modified_base (349)..(349): a, c, t, g, unknown or other
  modified_base (420)..(420): a, c, t, g, unknown or other
  modified_base (475)..(475): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaaactgctcatctcctgggcatctacccgggcacccggagtccctgaccgattcagtggcagcgggtctgggacagacttcnctctcaccatcagcaacctgcaggctgaagatgtgctagtttatactgtcagcagtatgtagaagctccgntcactttcggcggagggaccgcggtggagatcgagacgaactgtggctgcacctntctcgtctc

SEQ ID NO: 408497 - DNA, 571 bp, Homo sapiens
  misc_feature: GZ8MTXP02JJDSP.11.11.A11.1.454.CMB.2.raw
  modified_base (208)..(208): a, c, t, g, unknown or other
  modified_base (255)..(255): a, c, t, g, unknown or other
  modified_base (284)..(284): a, c, t, g, unknown or other
  modified_base (308)..(308): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttanatagtgtacaacgataaggacttattagcttggtatcagacaaaacnggacagcctacctaaactgctcatctccngggcatccgtacccggcacccggntccctgaccgattcagtggcacggcggtctgggacagtacttcgactctacaccatcagccaacctgacagctagaagatgtggacttagtttatacgtgtacagtactagttattgagaacgtctccgtctaccgtacgtttccgggacgggtacggggacccggtagggtacggagtactaccggaaaggacccgtaaacgttggaggtaaccgttacgggaccctaaaccgtacgttccttacggttcccgtttaacccg

SEQ ID NO: 408498 - DNA, 534 bp, Homo sapiens
  misc_feature: GZ8MTXP02HCJWQ.11.11.A11.1.454.CMB.2.raw
  modified_base (255)..(255): a, c, t, g, unknown or other
  modified_base (404)..(404): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttctttatatagtgtcaacgataaggactatttagcttggtatcagacaaaaaccnggacagcctacctaaactgctcatctcctgggcatcctacccgggcacccggatccctgaccgattcagtggcaggcgggtctgggacagtaccttcactctcaccatcagcaacctgcagctagaagatgtggctagtttatactgtnagctagttattgtagaagtctaccgctctacgtttcggacggacgggacccgcgggtggagtacgtcgaacggtacgaaaccgttggtacggcgttcggacctaacccgtatccgtacgttcctttaccc

SEQ ID NO: 408499 - DNA, 612 bp, Homo sapiens
  misc_feature: GZ8MTXP02I4WEJ.11.11.A11.1.454.CMB.2.raw
  modified_base (255)..(255): a, c, t, g, unknown or other
  modified_base (353)..(353): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaccnggacagcctacctaaactgctcatctcctgggcatcctacccggcacccggacgtccctgaccgattcgagtggcacggcggtctgggacagtactcnctctcaccatcacgcaaacctgcgtagctagaagatggtcgactagtttacttactgttacagtactagttattgttagaacgtccttccggtcttaccgtaaccgttttcggggaccggggttaacgggggaacccggtcggggttaacggggaagtaacgttacccggaaaggtacccggtaaaaccgttggggtcggtaacccgttcgggacccgtaaacccctaagtttccgtttacggtttccgtttaaccccg

SEQ ID NO: 408500 - DNA, 504 bp, Homo sapiens
  misc_feature: GZ8MTXP02FU31M.11.11.A11.1.454.CMB.2.raw
  modified_base (256)..(256): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccnggacagcctcctaaactgctcatctcctgggcatctacccgggcacccggatcccctgaccgattcagtggcagcggtctgggacagacttcactctcaccatcagcaactgcaggctagaagatgtggactagtttattacgtgttagctagttattgtagaagcctaccgctcgtacgtttcgggcgggaagggccggcggtggacgatcgaagacgtaactgtggctgcaccatctcgtctatac

SEQ ID NO: 408501 - DNA, 551 bp, Homo sapiens
  misc_feature: GZ8MTXP02G0RF8.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaaacgataaggactatttagcttggtatcagacaaaaaccaggacagcctacctaaactgctcatctcctgggcatctacccgggcaccccggatccctgaccgattccagtggcagcgggtctgggacagacttcactctcaccatcagcaacctgacaggctagaacgatgtggtactagtttattactgtcagctagttattgtagaagtcctccggtctacgtacgtttcgggacgggtacggggacccgtcgggtaggagacgttacgaacggtaccgaaacgtggtacggcttcggacctacccgtattccgtacgtttacctttaccg

SEQ ID NO: 408502 - DNA, 559 bp, Homo sapiens
  misc_feature: GZ8MTXP02HMO88.11.11.A11.1.454.CMB.2.raw
  modified_base (256)..(256): a, c, t, g, unknown or other
  modified_base (394)..(394): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttctttatatagtgtcaacgataaggactatttagcttggtatcagacaaaaaccnggacagcctacctaaactgctcatctcctgggcatccgtacccgggcacccggagtccctgaccgtattcagtggcacggcgggtctggggacagaccttcacctctcaccatcacgcaaccctgcaggctagaagtntgtggactaggtttatacgtgtcagtcagtttagtgtagaagtcctccgactcgtacgtttccggcgggtaacgggcccggtgggtaggagtacgtacgaacggtaccgtaacgtggtacggccgttacggaccctaccggtattccgtacgtttccctttaccg

SEQ ID NO: 408503 - DNA, 540 bp, Homo sapiens
  misc_feature: GZ8MTXP02GOZGD.11.11.A11.1.454.CMB.2.raw
  modified_base (255)..(255): a, c, t, g, unknown or other
  modified_base (356)..(356): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccnggacagcctctaaactgctcatctcctgggcatcctacccgggcaccccggagtcccctgacccgattcagtggcacgcggggtctggggacagaccttcnctctcaccatcagcaacctgcaggctagaagagtgtggctagtttattactgtcagtcagttattgtagaagcctccggtctccgtacgtttcgggacgggtacggggacccggtcgggtcggagacgtacgacggtaaccgaacgtggtcggcgtcgaccgtaccatccgttcgttactttcc

SEQ ID NO: 408504 - DNA, 542 bp, Homo sapiens
  misc_feature: GZ8MTXP02GA2RU.11.11.A11.1.454.CMB.2.raw
  modified_base (254)..(254): a, c, t, g, unknown or other
  modified_base (438)..(438): a, c, t, g, unknown or other
  modified_base (487)..(487): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttatatagtgtcaacgataaggacttattagcttggtatcagacaaaacnggacagcctacctaaactgctcatctcctgggcactccgtacccggccaccccggacgtccctacgaccgtattcgagtggcgacggcgggtcgtgggacagtaccttcactctacaccatcacgaccaaccgtgacgtaggctagaagtgtggtcggtacttaagtttatacgtgttacgagntagttattgtagaagcctcgctacgtacgttcggacgggacgggaccgngggtacggagtactccgaagaccgtagtggtgcgtcgactacagtctgttctacg

SEQ ID NO: 408505 - DNA, 514 bp, Homo sapiens
  misc_feature: GZ8MTXP02IEA3V.11.11.A11.1.454.CMB.2.raw
  modified_base (258)..(258): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggacttatttagcttggtatcagacaaaaaccnggacagcctcctaaactgctcatctcctgggcatcctacccgggcaccccggagtcccctgaccgattccagtggcagcgggtctggggacagaccttcactctacaccatccagcaacctgcaggctagaagatgtgctagtttatactgtacagtcagttattggtagagtcctccgctctacgtttcgggcggacgggaccgtcggtggagtactcgagacgacgtgtgaacgtgacacattctacgttctac

SEQ ID NO: 408506 - DNA, 516 bp, Homo sapiens
  misc_feature: GZ8MTXP02HWUFT.11.11.A11.1.454.CMB.2.raw
  modified_base (208)..(208): a, c, t, g, unknown or other
  modified_base (276)..(276): a, c, t, g, unknown or other
  modified_base (377)..(377): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttanatagtgtacaacgataaggacttatttagcttggtatcagacaaaaaccaggacagcctcctaaaacngctcatctcctgggcatcgtacccggcacccggatccctgaccgattcagtgcagcggtctggacagcttcactctcacatcagcaacctgcaggctgaanagtgtgactagtttatactgtacagtactagttaattggtagaacgtccgtaccgtctcgtaacgtttcgggacgggtacgggacccgtggggtgaagctaccgagacgtaactggtaggctgacaccatctgttactc

SEQ ID NO: 408507 - DNA, 550 bp, Homo sapiens
  misc_feature: GZ8MTXP02IC9GA.11.11.A11.1.454.CMB.2.raw
  modified_base (254)..(254): a, c, t, g, unknown or other
  modified_base (335)..(335): a, c, t, g, unknown or other
  modified_base (341)..(341): a, c, t, g, unknown or other
  modified_base (348)..(348): a, c, t, g, unknown or other
  modified_base (378)..(378): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtcccagatatcctgcctgtgtctctgggcgagagggccaccatcgagtgcaagtccagcgagacttcttttatatagtgtcaacgataaggcttattagcttggtatcagacaaaaaccnggacagcctactaaactgctcatctcctgggcatccgtaccccgggcacccggatccctgaccgattcagtgcaggcggtntggacngacttcnctctcaccatcagcaactgcaggctagaanatgtggactagtttacttactgtacagtacagttagttgtagagcgtccgctacgtacgtttcgggacgggtacgggacccggcgggtaggaggaacttcgaaacggtaaccgaaacgttggtacgggccttacggaccgtacctaactttccgttaggttacctttacccg

SEQ ID NO: 408508 - DNA, 582 bp, Homo sapiens
  misc_feature: GZ8MTXP02GRVCJ.11.11.A11.1.454.CMB.2.raw
  modified_base (256)..(256): a, c, t, g, unknown or other
  modified_base (310)..(310): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttatatagtgtcaaacgataaggactatttagcttggtatcagacaaaaccnggacagcctacctaaactgctcatctcctgggcagtcctaccccggcacccggntcccctgaccgtatcagtgcaggccgggtctaggggacagtaccttcgaccttcacaccatccaacgaccaaccctgcgaggctaggaaagtagtcggtacggtactaagttttaattaccgtgttaccgagtacgtaagtttagttggtacgaagtcccgttccgcttacgtacgtttccgggacgggtacggggtacccgtggggtacgagtacgtacgaacggtacgtacgtggtcggaactcggaccacgtctcgtcgttcctttacg

SEQ ID NO: 408509 - DNA, 670 bp, Homo sapiens
  misc_feature: GZ8MTXP02IFRUQ.11.11.A11.1.454.CMB.2.raw
  modified_base (212)..(212): a, c, t, g, unknown or other
  modified_base (413)..(413): a, c, t, g, unknown or other
tcagcgagagataccacgaccggtgctcgatttagctacgactgcaggggcagcaagatggtgttgcagacccaggtcttcatttctctgttgctctggatctctggtgcctggtggggacatcctgatgacccagtccccagatatcctgcctgtgtctcgtgggcgagagggccaccatcgagtgcaagtccagcgagtacttcttttanatagtgtacaacgataaggacttatttagcttggtatcagacaaaaaccaggacagcctacctaaactgctcatcctccgtgggcactccgtaccccggggcaaccccgggctccccgtagacccgtattcgaggtggacacggcggggtctaggggacacgtacttcacctctacaacctataccaacgacctaaacccngaccgaggtacctaggaaagagttgggtacggtacttaaggttttaactaccgtgttaccgagtacgtaaggtttagttaggtacgggtaactcccgtcccggtacttacccggttaacggtttccggggaccggggtaacggggacccgggtcggggttagggaacgtaacgtaccggaaaggtaacccgtaacggttgggtacgggcctacggaccctaaaccgtactttccgttacggtttaccctttaccccg

SEQ ID NO: 408510 - DNA, 509 bp, Homo sapiens
  misc_feature: GZ8MTXP02HDPHB.11.11.A11.1.454.CMB.2.raw
  modified_base (347)..(347): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctacctaaactgctcatctcctgggcatctacccggcacccggatccctgaccgattcagtggcagcggtctggacagacttcnctctcaccatcagcaacctgcaggctgaagatgtggctagtttatactgtacagcagttatgtgaagctccgctcgacgtttcggcggacgggaccgcggtaggagtactacgaacggacgaacgtggtcggcgtcgaccaccattccgtcgttctttaccg

SEQ ID NO: 408511 - DNA, 612 bp, Homo sapiens
  misc_feature: GZ8MTXP02I0UDW.11.11.A11.1.454.CMB.2.raw
  modified_base (260)..(260): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgaggagggccaccatcgagtgcaagtccagcgagacttctttatatagtgtacaaacgataaggacttatttagcttggtatcagaccaaaaacnggacagcctacctaaactgctcatcctcctgggcatccgtaccccggcaacccggcgtcccctgaccgtattccgaggtcggcgacggtccggggtcgtaggggaaccagtacctttcgaccttctaccaacccatccaagaccaaacctcgacgaggacctaggaaagagtggtcgggacttaaggttttactacgtcgtacagacgtaagttagttggtagaagtcctccgtctccgtacgtttcgggacgggtacggggaccgcgggtaggaagtacgtacgaaacggtaccgtaaaccggtggtcggaacgttcggacctaaaccctagttccgttacgttacctacg

SEQ ID NO: 408512 - DNA, 499 bp, Homo sapiens
  misc_feature: GZ8MTXP02I3AFQ.11.11.A11.1.454.CMB.2.raw
  modified_base (208)..(208): a, c, t, g, unknown or other
  modified_base (352)..(352): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtcaacgataaggactatttagcttggtatcagacaaaaaccaggacagcctcctaaaactgctcatctcctgggcatctacccgggcacccggagtcccctgaccgattcagtggcagcgggtctgggacagacttcnctctcaccatcagcaactgcaggctagaagatgtgctagtttatactgtcagcagtattgtagaagctcgctcacgtttcgggacggtagggaccgtcgggtggagactcgagacgaacgtgtaggctcgcaccatcctgtctttac

SEQ ID NO: 408513 - DNA, 554 bp, Homo sapiens
  misc_feature: GZ8MTXP02FR8SB.11.11.A11.1.454.CMB.2.raw
  modified_base (314)..(314): a, c, t, g, unknown or other
  modified_base (349)..(349): a, c, t, g, unknown or other
  modified_base (358)..(358): a, c, t, g, unknown or other
  modified_base (381)..(381): a, c, t, g, unknown or other
  modified_base (385)..(385): a, c, t, g, unknown or other
  modified_base (408)..(408): a, c, t, g, unknown or other
  modified_base (433)..(433): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactattagcttggtatcagacaaaaaccaggacagcctacctaaactgctcatctcctgggcatccgtacccggcacccggagtcccngaccgattcagtgcagcgggtctggacagacttcnctctcaccntcagcaacctgcaggctagaagntagngctaagtttatactgtactacgntagttattggtagaacgtcgtccgntcctacgtttcggaccggggtacggggacccgtcggggtaggagttagaccgaaaggacccgtaacgtggttacgggccttacggacccgtaccctaagttcctcggtttacctttacccg

SEQ ID NO: 408514 - DNA, 536 bp, Homo sapiens
  misc_feature: GZ8MTXP02HC0X0.11.11.A11.1.454.CMB.2.raw
  modified_base (208)..(208): a, c, t, g, unknown or other
  modified_base (255)..(255): a, c, t, g, unknown or other
  modified_base (358)..(358): a, c, t, g, unknown or other
  modified_base (391)..(391): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtcaacgataaggactattagcttggtatcagacaaaaaccnggacagcctacctaaactgctcatctcctgggcatcctacccgggcaccccggatcccctgaccgattcagtggcacggcggggtctggggacaggtacttcnctctcacctatcagcaacctgcaggctagaagntagtgctagtttattactgtacagactagttattgtagaagtcctaccgctctacgtttcgggacggagggacccgtcgggtagagacgtacgaacggtacgaactggtacggcgtcggacctactacgttcgtcgtctttaccg

SEQ ID NO: 408515 - DNA, 560 bp, Homo sapiens
  misc_feature: GZ8MTXP02IMCNC.11.11.A11.1.454.CMB.2.raw
  modified_base (208)..(208): a, c, t, g, unknown or other
  modified_base (254)..(254): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttanatagtgtcaacgataaggactattagcttggtatcagacaaaaacnggacagcctcctaaatgctcatcctcctgggcatcctaccccggcaccccggagtcccctgaccgtattcaggtggcaggcgggtctgggacagtaccttcactctcaccatcagccaacctgcaggctaggaagtatggtagcttagtttactacgttgtacagactagttacttggtaggaacgtccgttaccggcttacgtaccgtttcggggacgggacggggacccggtcgggtagagacgtacgacggtaacgtaaccgtggtcggaacgtcggactacctacttcgtcgttctttaccg

SEQ ID NO: 408516 - DNA, 530 bp, Homo sapiens
  misc_feature: GZ8MTXP02HQ1CM.11.11.A11.1.454.CMB.2.raw
  modified_base (280)..(280): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggacttatttagcttggtatcagacaaaaaccaggacagcctacctaaactgctnatctcctgggcatcctacccggcacccggatccctgaccattcagtggcacggcgggtctgggacagacttcactctcacatcagccaacctgaccaggctagaagagtgtggcttaagtttatactgtcagctagttattgtagaacgcgtaccgcttcgtacgtttcgggacgggtacgggacccggtcgggtaggagactacgaacggaccgtaacgtgtgaacgtgactacattctcgttacttcc

SEQ ID NO: 408517 - DNA, 512 bp, Homo sapiens
  misc_feature: GZ8MTXP02F2W9E.11.11.A11.1.454.CMB.2.raw
  modified_base (383)..(383): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttatatagtgtcaacgataaggactatttagcttggtatcagacaaaaaccaggacagcctacctaaactgctcatctcctgggcatctacccggcacccggatccctgaccgattcagtggcacgcggtctgggacagacttcactctcacatcagcaacctgcaggctagaagatgnggctagtttatactgtacagcagtattgtagaagctccgctctacgttcggacggacgggaccgcgggtaggagtatcgaacggacgtaacgtggtcggcgtcgacctaccgattcgtcgttctttacc

SEQ ID NO: 408518 - DNA, 535 bp, Homo sapiens
  misc_feature: GZ8MTXP02JLUD4.11.11.A11.1.454.CMB.2.raw
  modified_base (311)..(311): a, c, t, g, unknown or other
  modified_base (355)..(355): a, c, t, g, unknown or other
  modified_base (387)..(387): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggactatttagcttggtatcagacaaaaaccaggacagcctcctaaactgctcatctcctgggcatcctaccccgggcaccccggntcccctgaccgattccagtggcagcgggtctgggacagacttcnctctcaccatcagccaacctgcaggctagaanagtgtggctagtttatactgtcagctagtattgagaagctaccgctctacgtttcgggacgggtagggacccgtcgggtaggagacgtcgaacggtaccgaacgttggtcgggctcggacctaccgtattccgtcgttacctttaccg

SEQ ID NO: 408519 - DNA, 543 bp, Homo sapiens
  misc_feature: GZ8MTXP02HJQEZ.11.11.A11.1.454.CMB.2.raw
  modified_base (325)..(325): a, c, t, g, unknown or other
  modified_base (403)..(403): a, c, t, g, unknown or other
  modified_base (407)..(407): a, c, t, g, unknown or other
  modified_base (436)..(436): a, c, t, g, unknown or other
tcagcgagagataccacgaccggtgctcgatttagctacgactgcaggggcagcaagatggtgttgcagacccaggtcttcatttctctgttgctctggatctctggtgcctggtgggacatcctgatgacccagtccccagatatcctgcctgtgtctcgtgggcgagagggccaccatcgagtgcaagtccagcgagtacttcttttatatagtgtacaacgataaggacttatttagcttggtatcaagacaaaaaccaggacagcctacctaaactgctcatctcctgggcatccgtaccccgggcaccccggacgtcccngaccgattccgagtcggcaggcgggtctggggacagtacttcactctacaccatcagcaaacctgcaggctagaaagngtgnggctagtttactactgtacaagcaagttnttgagagtcctaccggcttacgtacgttccgggacggtacgggacccgtgggtacggagactcgaacgtaccgaactggtggaactgaccaccatcctcgttctacc

SEQ ID NO: 408520 - DNA, 524 bp, Homo sapiens
  misc_feature: GZ8MTXP02ITWCA.11.11.A11.1.454.CMB.2.raw
  modified_base (355)..(355): a, c, t, g, unknown or other
  modified_base (426)..(426): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagactcttttatatagtgtcaaacgataaggactatttagcttggtatcagacaaaaaccaggacagcctacctaaaactgctcatctcctgggcatcctacccggcaccccggagtcccctgaccgattccagtggcagcgggtctgggacagacttcnctctcaccatcagcaacctgcaggctagaagatgtggctagtttatactgtacagctagttattgagaacncctccgcttcgtacttcggggacgagggacccgcggtaggagacgtcgaaggaccgtaacgtggtacggctacggacaccgtatcgtcgttctttacc

SEQ ID NO: 408521 - DNA, 620 bp, Homo sapiens
  misc_feature: GZ8MTXP02GTS6X.11.11.A11.1.454.CMB.2.raw
  modified_base (360)..(360): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaacgataaggacttattagcttggtatcagacaaaaccaggacagcctactaaactgctcatctccgtgggcatcctacccggcacccggacgtccctgaccgtattcgagtcggcacggcgggtctgggacagtaccttcnctctcaccatccagaccaaccgtgcaggctagaagagtggtcggacttaagttttactacgtgtacagtactagttattggtaggaacgtccgtcccgtaccgttcgtaaccggtttcggggaccggggtaacgggggtaccccgggtacggggttagggaacgtacgttaccggaacgggtaacccggtaaacgttcgggttcggaacgttaccggacctaaaccccgtagttcccgtttcggtttaccctttaccccg

SEQ ID NO: 408522 - DNA, 576 bp, Homo sapiens
  misc_feature: GZ8MTXP02H3NQB.11.11.A11.1.454.CMB.2.raw
  modified_base (209)..(209): a, c, t, g, unknown or other
  modified_base (356)..(356): a, c, t, g, unknown or other
  modified_base (375)..(375): a, c, t, g, unknown or other
tcagcgagagataccacgaccggtgctcgatttagctacgactgcaggggcagcaagatggtgttgcagacccaggtcttcatttctctgttgctctggatctctggtgcctggtggggacatcctgatgacccagtccccagatatcctgcctgtgtctctgggcgagagggccaccatcgagtgcaagtccagcgagacttctttanatagtgtacaacgataaggacttatttagcttggtatcagacaaaaaccaggacagccctacaaactgctcatctcctgggcatccgtacccggcacccggactcccgtgaccgatcaggtgcacggcgggtctgggacagacttcnctctacaccatcagcaacngcaggctagaagatggtcgactagtttaattacgtgtacagtagtagttaattagtaggaaacgccgtcccgtactccgtaacgtttccggggacgggacgggaacccggtgggtaacgggagaaagttcggaaacggaaccgtaaacgttggtcgggtcctacggacccgaacccgtaagttccttacgttcccttaccg

SEQ ID NO: 408523 - DNA, 636 bp, Homo sapiens
  misc_feature: GZ8MTXP02H08IN.11.11.A11.1.454.CMB.2.raw
  modified_base (364)..(364): a, c, t, g, unknown or other
  modified_base (397)..(397): a, c, t, g, unknown or other
  modified_base (405)..(405): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagacttcttttatattagtgtacaaacgtataaggacttatttagcttggtatcaagacaaaaaccaggacagcctacctaaactgctcatctcctgggcatccgtacccggcacccggacgtccctgaccgattccgagtcggcaggcggtctgggacagtactcnctctcaccatacacgacaaaccgtgacacggtntagaaagngttaggtggtaccttaggtttaacttacgtgtaccgtaagcgtaaaggtttagttaccggtagaaaccggtccttacccggacgttccgtaaaccggttttcccgggggaggggaaacccggggttaacccgggggtacgggtaaggaacgtaacgtaccggaaacggtaacgtacggttcggtacggccgtacgaacccgtaccgtacgttccgtttacgtttacctacg

SEQ ID NO: 408524 - DNA, 554 bp, Homo sapiens
  misc_feature: GZ8MTXP02IYMHT.11.11.A11.1.454.CMB.2.raw
  modified_base (357)..(357): a, c, t, g, unknown or other
  modified_base (384)..(384): a, c, t, g, unknown or other
  modified_base (388)..(388): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaaacgataaggacttatttagcttggtatcagacaaaaaccaggacagccctacctaaactgctcatctcctgggcatcctacccggcaccccggagtcccctgaccgattcagtggcagcgggtctgggacagacttcnctctcaccatcagcactgcagctgaanatgngctagtttatactgtcagcagttattgtagaacgctccgctcgtacgtttcgggacgggtagggacccggtcgggtaggagacgtccgaaaggtaccgaaaaccggttggttacgggccgttcggacctaaaccccgttacgtttaccgttcgtttacctttaccg

SEQ ID NO: 408525 - DNA, 611 bp, Homo sapiens
  misc_feature: GZ8MTXP02JY9I9.11.11.A11.1.454.CMB.2.raw
  modified_base (255)..(255): a, c, t, g, unknown or other
  modified_base (353)..(353): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtacaacgataaggactatttagcttggtatcagacaaaacnggacagcctacctaaactgctcatctcctgggcatccgtaccccggcacccggactccctgaccgattcgagtggcaggcgggtctgggacagcttcnctctcaccatcagccaactgacgaggctagaagatggtacggacttaaggtttattactggtacagtctaagttagttgtagaacgtcccgtaccgtccttaccggtaccgtttaccgggggaccgggtacgggggaccccggtgggggttacgggaaacggtacgttacggaacggtaaccggtaaaccggttgggtaaccgggcgttaccgggaccctaaccgtacgtttcccgttacggtttccctttaccccgg

SEQ ID NO: 408526 - DNA, 514 bp, Homo sapiens
  misc_feature: GZ8MTXP02IXNPL.11.11.A11.1.454.CMB.2.raw
  modified_base (350)..(350): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaaacgataaggactattagcttggtatcagcaaaaccaggacagcctctaaactgctcatctcctgggcatcctacccgggcacccggagtccctgaccgtattcagtggcagcgggtctgggacagacttcnctctcaccatcagcaacctgcaggctagaagatgtggctagtttatactgtctagctagttattgagaacgccgtccgctcgacgtttcgggacgggtacgggccggcgggtggagactacgacgaccgaaacgtgtcggctgcctacctatccgtgttccttc

SEQ ID NO: 408527 - DNA, 559 bp, Homo sapiens
  misc_feature: GZ8MTXP02HFDOS.11.11.A11.1.454.CMB.2.raw
  modified_base (208)..(208): a, c, t, g, unknown or other
  modified_base (257)..(257): a, c, t, g, unknown or other
  modified_base (316)..(316): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttanatagtgtacaacgataaggactatttagcttggtatcagacaaaaaccnggacagcctactaaactgctcatctacctgggcactccgtacccggcacccggatcccngaccgattcagtgcaggcggtctgggacagacttcactctcaccatcagccaaactgacaggctaggaaagtatggtggtacttaaggtttattacgtgttaccaggtactagtttagttgtaggaacgtcctccgcttccgtacgtttccggggacggtacgggaccgcgggttaggagtacgcgaacgacgtaaactgggttacggcttcggaccacctaattcccgtttcgttccttacg

SEQ ID NO: 408528 - DNA, 484 bp, Homo sapiens
  misc_feature: GZ8MTXP02JU003.11.11.A11.1.454.CMB.2.raw
  modified_base (208)..(208): a, c, t, g, unknown or other
  modified_base (255)..(255): a, c, t, g, unknown or other
  modified_base (385)..(385): a, c, t, g, unknown or other
  modified_base (395)..(395): a, c, t, g, unknown or other
  modified_base (452)..(452): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtcaacgataaggactatttagcttggtatcagcaaaaaccnggacagcctcctaaactgctcatctcctgggcatcctacccggcacccggagtccctgaccgattcagtggcagcgggtctgggacagacttcactctcacctatcagcaaacctgcaggctgaagatgnggctagtttntactgtcagcagtatgtgaagcctccgcttcacgtttcggcggacggcgcggtgganatcgacgacgaactgtgctgcacatctgtctc

SEQ ID NO: 408529 - DNA, 615 bp, Homo sapiens
  misc_feature: GZ8MTXP02HR490.11.11.A11.1.454.CMB.2.raw
  modified_base (218)..(218): a, c, t, g, unknown or other
  modified_base (603)..(603): a, c, t, g, unknown or other
tcagcgagagataccacgaccggtgctcgatttagctacgactgcaggggcagcaagatggtgttgcagacccaggtcttcatttctctgttgctctggatctctggtgcctggtggggacatcctgatgacccagtccccagatatcctgcctgtgtctcgtgggcgagagggccaccatcgagtgacaagtccagcgagaccttctttatatagtntacaacgataaggacttatttagcttggtatcaagaacaaaacaggacagcctacctaaatgctcatcctccgtgggcctatccgtaccccgggccaccccgggacttcccgtagaccgtattcgaggtcggaccgaggtccggggtctacggggacacggtaccctttcaccttctaccaaccgtataccaacggacccaaaccgtcgaccacgggtacctaggaaggagttggtgggtacttaaggtttacttaccgtagttaccgaggtactagttagttagttaggaacgtcctccgtctccgtacggttacgggcgggaacggggcccggtcgggtaggagacgtacgacggaacgtacgtcggtggctcgaccaccgtntcgtcgttctcg

SEQ ID NO: 408530 - DNA, 558 bp, Homo sapiens
  misc_feature: GZ8MTXP02GWN24.11.11.A11.1.454.CMB.2.raw
  modified_base (414)..(414): a, c, t, g, unknown or other
  modified_base (490)..(490): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagacttcttttatatagtgtacaacgataaggacttatttagcttggtatcagacaaaaaccaggacagcctacctaaactgctacactctccgtgggcatccgtaccccgggcaaccccgggacgtccccgtgacccgtattcagtcggcacggtcggtcgtggacagtaccttcactcctcaaccatcacgccaaacctgacgaggctagaaagngtgtggtctagtttatactgtacagctagttatgtagaacgtctccgctactacgttcgggacggacggggcccgngggtaggagtacgtacgacggtacgaacgtggtaggccgtacgcctacccattcgtcgtctttacccg

SEQ ID NO: 408531 - DNA, 715 bp, Homo sapiens
  misc_feature: GZ8MTXP02JBHW1.11.11.A11.1.454.CMB.2.raw
  modified_base (256)..(256): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagagggccaccatcgagtgcaagtccagcgagtacttcttttatatagtgtacaacgataaggacttattagcttgtatcagacaaaacnggacagcctacctaactgctcatctccgtggcatccgtacccggcaccccggactcccctgaccgtattcgagtcggcacggtccgggtcgtcggggacacgtaccttcaccttcctaccaaccctactaccgacgtacccaaaccgtcgacgtaacggccgttaaggaaacgtagttacgggtacggtaccgttaaaggtttttaactaccgttacggttaccgaacggtaccgttaaagggttttacgtttacgggtaagggtaaacccggtcccttacccgtccgtttaccggttacccgggtttaccgggggacggggtaaaccgggggaccccgggtacggggtaggggtaaacgtacggttaaaccgaaacgggtaacccgtaaacggttcgggttaacggccgttacggaccctaaaccggtactttccgttaccggtttccgtttaacccg

SEQ ID NO: 408532 - DNA, 521 bp, Homo sapiens
  misc_feature: GZ8MTXP02HIY1X.11.11.A11.1.454.CMB.2.raw
  modified_base (351)..(351): a, c, t, g, unknown or other
  modified_base (382)..(382): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctacctaaactgctcatctctgggcatcctaccccggcacccggatcccctgaccgattcgagtgcacgcgggtctgggacagacttcnctctcaccatcagcaaccctgcaggctgaanatggtgactagtttatactgtacagtcagttattgtagaagtcctccgcttctacgtttcgggcgggtagggacccggtcggtaggaggtactcggaacgtaccgaacgtgtcggctcgacaccatccgtcgttctacc

SEQ ID NO: 408533 - DNA, 558 bp, Homo sapiens
  misc_feature: GZ8MTXP02IJMC5.11.11.A11.1.454.CMB.2.raw
  modified_base (359)..(359): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttatatagtgtcaacgataaggactattagcttggtatcagacaaaaaccaggacagcctactaaactgctcatctcctgggcatccgtaaccccgggcaccccggacgtccccgtgaccgattcgagtggcacgcgggtctgggacagacttcnctctcacatcagcaacctgacaggctagaagtagtggtacggtacttaagtttacttaaccgtggttacaggtacctaagttagtttggtagtaacgtcctaccgtcttacgtacgtttcgggacgggtacgggacccggcgggtaggagactacgaacggacgaacgtgtaggctcgactacatcgtcgtctttaccg

SEQ ID NO: 408534 - DNA, 497 bp, Homo sapiens
  misc_feature: GZ8MTXP02HU7UP.11.11.A11.1.454.CMB.2.raw
  modified_base (352)..(352): a, c, t, g, unknown or other
  modified_base (455)..(455): a, c, t, g, unknown or other
  modified_base (478)..(478): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttctttatatagtgtcaacgataaggactatttagcttggtatcagacaaaaccaggacagcctacctaaactgctcatctcctgggcatcctacccgggcaccccggagtccctgaccgattcagtggcagcgggtctgggacagacttcnctctcaccatcagcaacctgcaggctagaagatgtggactagtttattactgtcagcagttattgtgaagctaccgctcacgtttcggaggtacggggaccgngggtggagatcgagacgtactgnggctgacaccatctgtctc

SEQ ID NO: 408535 - DNA, 523 bp, Homo sapiens
  misc_feature: GZ8MTXP02IFPUL.11.11.A11.1.454.CMB.2.raw
  modified_base (208)..(208): a, c, t, g, unknown or other
  modified_base (247)..(247): a, c, t, g, unknown or other
  modified_base (258)..(258): a, c, t, g, unknown or other
  modified_base (352)..(352): a, c, t, g, unknown or other
  modified_base (440)..(440): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttanatagtgtcaaacgataaaggacttatttagcttggtatnagcaaaaaccnggacagctcctaaactgctcatctcctgggcatctacccggcacccggagtccctgaccgattcagtggcagcgggtctgggacagtaccttcnctctcaacccatccacgcaaaccctgacaggctgaaagatggtggactagtttatactgtacagtcaggttattcgtgaacgctccgntcacgtttcggcggacgggacccgtggtgacgatacgaacgacgaacgttgcggaactcggactaccattctacgtttctacc

SEQ ID NO: 408536 - DNA, 561 bp, Homo sapiens
  misc_feature: GZ8MTXP02H5RT5.11.11.A11.1.454.CMB.2.raw
  modified_base (185)..(185): a, c, t, g, unknown or other
  modified_base (204)..(204): a, c, t, g, unknown or other
  modified_base (210)..(210): a, c, t, g, unknown or other
  modified_base (365)..(365): a, c, t, g, unknown or other
  modified_base (397)..(397): a, c, t, g, unknown or other
  modified_base (549)..(549): a, c, t, g, unknown or other
tcagcgagagataccacgaccggtgctcgatttagctacgactgcaggggcagcaagatggtgttgcagacccaggtcttcatttctctgttgctctggatctctggtgcctggtggggacatcctgatgacccagtcccagatatcctgcctgtgtctcgtgggcgagagggccacatcgagtncaagtccagcgagtacttnttttanatagtgtacaacgataaggacttatttagcttggtatcagacaaaaacaggacagcctaccaaactgctcactctccgtgggcactccgtacccgggccacccggacgtccctagaccattccgagtcggcacggcggtcgtgggacagacttcnctctcaccatcacgcaacctgcagctagaagntgtggactagtttaactcgtgtacgagtctagttatttggagtaacgccttaccgctccgtacggtttcggggaccgggacggggtacccggcgggtagggacgtactacgaacggtaacccgtacgtggttcgggcttcggacctaccgtntcgtcgttactc

SEQ ID NO: 408537 - DNA, 493 bp, Homo sapiens
  misc_feature: GZ8MTXP02HNXG0.11.11.A11.1.454.CMB.2.raw
  modified_base (208)..(208): a, c, t, g, unknown or other
  modified_base (348)..(348): a, c, t, g, unknown or other
  modified_base (379)..(379): a, c, t, g, unknown or other
  modified_base (410)..(410): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtcaacgataaggactatttagcttggtatcagcaaaaaccaggacagcctacctaaactgctcatctcctgggcatctacccggcacccggagtccctgaccgattcagtgcagcgggtctgggacagacttcnctctcaccatcagcaacctgcaggctgaagntgtggctagtttattactgtacagtcagttntgtgaagctaccgctctacgttcggcggtacgggccgtcggtggagctcgaagacgaacgtgtggctgcaccgatctgtcttc

SEQ ID NO: 408538 - DNA, 576 bp, Homo sapiens
  misc_feature: GZ8MTXP02G1ETW.11.11.A11.1.454.CMB.2.raw
  modified_base (389)..(389): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttctttatatagtgtcaacgataaggactattagcttgtatcagacaaaacaggacagcctactaaactgctcatctcctgggcatcctacccgggcacccggatccccgtgaccgattcaggtgcacggcgggtctggggacagacttcactcctacaccatcacgcaaacctgacaggctagaaagngtaggtggactaagttttactactgtaccagtactaagttattgtagtaaagcccttacgaccttacgttacgttccgggacgggtagggggaccccggtagggtacggaagtacgtacgaaacggtacgtaaaccggttggtacggcgttacggaccctacctaacgttccgtcgttaccgtttcc

SEQ ID NO: 408539 - DNA, 566 bp, Homo sapiens
  misc_feature: GZ8MTXP02GVDV8.11.11.A11.1.454.CMB.2.raw
  modified_base (207)..(207): a, c, t, g, unknown or other
  modified_base (254)..(254): a, c, t, g, unknown or other
  modified_base (348)..(348): a, c, t, g, unknown or other
  modified_base (362)..(362): a, c, t, g, unknown or other
  modified_base (366)..(366): a, c, t, g, unknown or other
  modified_base (371)..(371): a, c, t, g, unknown or other
  modified_base (394)..(394): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagaggccaccatcgagtgcaagtccagcgagacttcttttanatagtgtcaacgataaggactattagcttggtatcagacaaaaaccnggacagccctacctaaactgctcatctcctgggcatccgtaccccgggcaccccggagtcccctggacccgtattccaggtggcaggccgggtntggggacagcttcnctcncaccntccagcaacctgcaggctagaanagtgtggctaggtttatactggtacagtctagttagtgtagtaacgtcctccgcttcgtaaccggtttcgggcggggtaacgggcccggcggggttaggacgttacgccgaaaggtaccggtaaacgtggttacgggcttacggcctaacctacttccgttcgttccttacg

SEQ ID NO: 408540 - DNA, 532 bp, Homo sapiens
  misc_feature: GZ8MTXP02FYZ18.11.11.A11.1.454.CMB.2.raw
  modified_base (254)..(254): a, c, t, g, unknown or other
  modified_base (345)..(345): a, c, t, g, unknown or other
  modified_base (352)..(352): a, c, t, g, unknown or other
  modified_base (387)..(387): a, c, t, g, unknown or other
  modified_base (517)..(517): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagactcttttatatagtgtcaacgataaggactatttagcttggtatcagcaaaaaccnggacagcctcctaaactgctcatctcctgggcatctaccccgggcaccccggagtcccctgaccgattcagtggcagcgggtctggggacngacttcnctctcaccatcagcaacctgcaggctagaagatgnggctagtttatactgtcagcagtattgtagaagtcctaccgctccgtacgtttcgggacgggtacggggaccgcgggttagggacgagtacgaacggtaccgtaaacgtggtacggcgtcgacctaaccnttctcgtctttaccg

SEQ ID NO: 408541 - DNA, 616 bp, Homo sapiens
  misc_feature: GZ8MTXP02GQ5HE.11.11.A11.1.454.CMB.2.raw
  modified_base (274)..(274): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagacttcttttatatagtgtacaaacgataaggacttattagcttggtatcagacaaaacaggacagcctactaacncgctcatcctcgtggcatccgtacccggccgacccggactcccgtagaccgtattcgaggtcggcgacggtccggggtctacggggaacacggtaccttcgccttcctaccaaccctactccgaacgacctaaaccctcgacgaacggtcgtaaggaaagtagttgggtacgggtactttaagtttacttacgtagttacgagtactagttagttggtacgacgtcctacgtctacgtacggttccggggacgggtacgggtaccggcgggttaggacgtacgtacggaacggtaacgaccgtgtacggcttacgaccgtaactcgttctcgttaccttccg

SEQ ID NO: 408542 - DNA, 600 bp, Homo sapiens
  misc_feature: GZ8MTXP02II5EJ.11.11.A11.1.454.CMB.2.raw
  modified_base (312)..(312): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaacgataaggacttatttagcttggtatcagacaaaaacaggacagcctcctaaactgctcatctcctgggcatccgtacccgggcaccccggngtcccctgaccattcagtgcagcggtctggacagacttcactctacaccatcagaccaacctgcaggctagagtatggtgtctagtttaattacgtgtacagtactagttaattgtagtaacgtccgtaccgtcttcgtaaccggtttcggggacggggtacggggacccggtacggggttagggaaacgtacgttaacggaaacgggtaccggtaaaaccgttggtaaccggggtaaccttcggacccgtacccttaagtttcccgtttaggtttccctttaacccg

SEQ ID NO: 408543 - DNA, 522 bp, Homo sapiens
  misc_feature: GZ8MTXP02FVE8U.11.11.A11.1.454.CMB.2.raw
  modified_base (359)..(359): a, c, t, g, unknown or other
  modified_base (392)..(392): a, c, t, g, unknown or other
  modified_base (470)..(470): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctactaaactgctcatctcctgggcatccgtacccggcaccccggagtcccctgacccgtattcagtcggcaggcgggtctggggacagaccttcnctctcaccatcagcaacctgcaggctagaaagngtgcggtactagtttatactgttacagtcagttattgtagaacgcctcgcttctacgtttcgggacggaagggcccgnggtgagctacgagtaccgaatggtaggctcgactaccatcgtcgttccttac

SEQ ID NO: 408544 - DNA, 639 bp, Homo sapiens
  misc_feature: GZ8MTXP02HSPJ3.11.11.A11.1.454.CMB.2.raw
  modified_base (204)..(204): a, c, t, g, unknown or other
  modified_base (261)..(261): a, c, t, g, unknown or other
  modified_base (284)..(284): a, c, t, g, unknown or other
  modified_base (419)..(419): a, c, t, g, unknown or other
tcagcgagagataccacgaccggtgctcgatttagctacgactgcaggggcagcaagatggtgttgcagacccaggtcttcatttctctgttgctctggatctctggtgcctggtgggacatcctgatgacccagtcccagatatcctgcctgtgtctcgtgggcgagagggccaccatcgagtgcaagtccagcgagtacttnttttatatagtgtacaaacgataaggacttatttagcttggtatcagacaaaaaccnggaacagcctacctaaactgctnatctccgtgggcatccgtaccccgggcacccggacgtccctgaccgtattccgaggtcggacacgggtccggggttacgtggggaacctaggtaaccttcaccttctaccaaccactacgacgacctaaacccgngacgagtacgtagaagtagtggtacgtacgttaagtttacgtacgtcgtacgtagtacgtagtttagttaggtacgtacgtccgtaccgtacgttaccggttacggttaccggggaacggggaccggggtaccgggtacgggtacggtacgtaacgtacggaaacggtacgtacgtggtacgtcgtacgacctactacgttccgttacgtttaccttacg

SEQ ID NO: 408545 - DNA, 577 bp, Homo sapiens
  misc_feature: GZ8MTXP02GS1SO.11.11.A11.1.454.CMB.2.raw
  modified_base (211)..(211): a, c, t, g, unknown or other
  modified_base (264)..(264): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagacgggccaccatcgagtgcaagtccagcgagacttcttttaanattagtgtacaaacgtataaggacttatttagcttggtatcagacaaaaaccnggacagcctacctaaatgctcatctcctgggcactccgtacccggccacccggacgtccctgaccgtattcgagtcggcaggcgggtctgggactagacttcacctctcaccatcacgaccaaactgacacggctagaagagtgtgactagtttatacgtgtacagtacgagtttagttagtagtaacgtccttccggaccttacgtaccggtttcgggacgggtacgggacccggtcgggtaggagtacgtaccgaaggtaccgtaaagtcggtacggcttacggacctacctactcggtcgttactttacc

SEQ ID NO: 408546 - DNA, 599 bp, Homo sapiens
  misc_feature: GZ8MTXP02JNAMH.11.11.A11.1.454.CMB.2.raw
  modified_base (251)..(251): a, c, t, g, unknown or other
  modified_base (356)..(356): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagaggccaccatcgagtgcaagtccagcgagactcttttatatagtgtcaacgataaggactatttagcttggtatcagcaaaacnggacagcctcctaaactgctcatctcctgggcatccgtacccggcaccccggacgtccctagacccgtattcgagtcggcacggcgggtctgggacagtacttcnctctcaccatcagcaacctgcaggctagaagtagtgtggctaagtttatacgtgtacagctagttagttgtagaagtcctcccggtcttaccgtcgtttccgggggcgggtaacggggtaccccggtcggggttacggggaaggtacgttacccggaaaggttacccgggaaaaccgttggggttacgggccgttaggaccctaaaccccggtttacgttccgtttacgtttaccctttaccg

SEQ ID NO: 408547 - DNA, 573 bp, Homo sapiens
  misc_feature: GZ8MTXP02IW0J6.11.11.A11.1.454.CMB.2.raw
  modified_base (368)..(368): a, c, t, g, unknown or other
  modified_base (373)..(373): a, c, t, g, unknown or other
  modified_base (388)..(388): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatcgacccagtccccagatatcctgcctgtgtctcgtgggcgagagggccaccatcgagtgacaagtccagcgagacttcttttatatagtgtacaaacgataaggtacttattagcttggtatcaagacaaaaccaggacagccctactaaactcgctcatcctccgtgggcactccgtaccccggcaccccggctccctgaccgtattcgaggtcgcacggcggtctgggacagtccttcncttcncacatcagaccaacngcaggctagagagtgtagtctagtttattactagtcagtctagttagttgtagtaacgtcccgtccgtctaccgtacggttcgggacgggtacgggacccggtcgggtaggagtacgtacgacggtaacgaacgttcggtcggtaaccgtcgaccctacgtactttccgtcgtttccgtttaccc

SEQ ID NO: 408548 - DNA, 604 bp, Homo sapiens
  misc_feature: GZ8MTXP02HW47J.11.11.A11.1.454.CMB.2.raw
  modified_base (367)..(367): a, c, t, g, unknown or other
tcagcgagagataccacgaccggtgctcgatttagctacgactgcaggggcagcaagatggtgttgcagacccaggtcttcatttctctgttgctctggatctctggtgcctggtggggacatcctgatgacccagtccccagatatcctgcctgtgtctcgtgggcgagagggccaccatcgagtgcaagtccagcgagacttcttttatatagtgtacaacgataaggacttatttagcttggtatcagacaaaacaggacagcctacctaaactgactcatctcctgggcactccgtacccggcaccccggacgtccctgaccgtattcgaggtggcacggcgggtctggggacagtaccttcnctctacaccatcacgacaaccctgacgagctagaagagtggtcgcttagtttattactgtacagtactagttagttgtagaacgtcgtccgtacttccgtacggtttaccgggcgggtacggggtaccggtcggggttaggacggtaacgtacggaaacggaaccggtaaacgttcgggtacgggtccgttacggacccgtaaccttacgttaccgtttcggtttaccctttacccg

SEQ ID NO: 408549 - DNA, 569 bp, Homo sapiens
  misc_feature: GZ8MTXP02II3RE.11.11.A11.1.454.CMB.2.raw
  modified_base (253)..(253): a, c, t, g, unknown or other
  modified_base (269)..(269): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagactcttttatatagtgtcaacgataaggactatttagcttggtatcagacaaaacnggacagcctctaaacngctcatctcctgggcatccgtaccccggcaccccggagtcccctgacccgattcagtgcaggcggtctgggacagaccttcactctcaccatcagcaactgcaggctagagatgtggactagtttatacgtgtacagctagttattgttagaacgtcctaccgcttacgtacgtttcggggacgggtacggggaccggtacgggtacgggagacgttacggaacggtaaccggtaaaaccgttgggttacggccgttacggacctaaccctacgttccgtttacgttacccgtttacccg

SEQ ID NO: 408550 - DNA, 546 bp, Homo sapiens
  misc_feature: GZ8MTXP02JDLD2.11.11.A11.1.454.CMB.2.raw
  modified_base (314)..(314): a, c, t, g, unknown or other
  modified_base (320)..(320): a, c, t, g, unknown or other
  modified_base (343)..(343): a, c, t, g, unknown or other
  modified_base (349)..(349): a, c, t, g, unknown or other
  modified_base (378)..(378): a, c, t, g, unknown or other
  modified_base (427)..(427): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagagggccaccatcgagtgcaagtccagcgagacttcttttatatagtgtacaacgataaggacttattagcttaggtatcagacaaaaaccaggacagcctactaaactgctcatctcctggcatcctacccggcacccggatcccngaccgnttcgagtggcagcggtctggacngactcnctctcacatcagcaactgcaggctagagntgtagctagtttatacgtgtacagtctagtattgtagaactcgtcccgnttccgtacgtttcgggacggtacgggaccgtcgggtaggagacgtaccgaaggtaccgaaacggtcggtaggtccgtacggaccctaacccgtattacccgttacggttctttaacccg

SEQ ID NO: 408551 - DNA, 503 bp, Homo sapiens
  misc_feature: GZ8MTXP02I5BV8.11.11.A11.1.454.CMB.2.raw
  modified_base (208)..(208): a, c, t, g, unknown or other
  modified_base (349)..(349): a, c, t, g, unknown or other
  modified_base (380)..(380): a, c, t, g, unknown or other
  modified_base (417)..(417): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtcaacgataaggactatttagcttggtatcagacaaaaaccaggacagcctacctaaactgctcatctcctggcatctacccggcacccggagtccctgaccgattcagtggcacgcggtctgggacagacttcnctctcaccatcagcaacctgcaggctagaanagtgtggctagtttatacgtgttagctagtattgtanagtctccgctctacgtttcggcggagggaccgcggtaggagatcgaggtacgaacgtgtcggctgacacgtactctcgtctactac

SEQ ID NO: 408552 - DNA, 517 bp, Homo sapiens
  misc_feature: GZ8MTXP02JHNK3.11.11.A11.1.454.CMB.2.raw
  modified_base (253)..(253): a, c, t, g, unknown or other
  modified_base (378)..(378): a, c, t, g, unknown or other
  modified_base (504)..(504): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttctttatatagtgtcaacgataaggactatttagcttggtatcagcaaaaccnggacagcctcctaaatgctcatctcctgggcatccgtacccggcacccggatccctgaaccgattcagtggcacggcggtctggacagacttcgactctcacatcagcaactgcaggctgaaagntagtggactaagtttatactgtaccagcagttatgtagaagctcgactctaacgttcggacggtacgggacccgtggtggagacgtcgaacgtacgaaacgtggtacgcgttacggcaacccgttntccgtcgtactcg

SEQ ID NO: 408553 - DNA, 520 bp, Homo sapiens
  misc_feature: GZ8MTXP02GFTG4.11.11.A11.1.454.CMB.2.raw
  modified_base (253)..(253): a, c, t, g, unknown or other
  modified_base (307)..(307): a, c, t, g, unknown or other
  modified_base (333)..(333): a, c, t, g, unknown or other
  modified_base (340)..(340): a, c, t, g, unknown or other
  modified_base (374)..(374): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggactattagcttggtatcagcaaaacnggacagcctctaaactgctcatctctgggcatcgtacccggcacccggatcccngaccattcagtgcagcggtctggacngtactcnctctcaccatcagccaactgcagctagaagatgngctagtttatactgtcagctagtatgtagaagtctccgtctacgtacgtttcgggcgggtaaggggacccgtcgggtaggagtacgtacgaacggtaccgaaacttggtaggctcggactacccgtattcctcggttactttcccg

SEQ ID NO: 408554 - DNA, 575 bp, Homo sapiens
  misc_feature: GZ8MTXP02JWJQ5.11.11.A11.1.454.CMB.2.raw
  modified_base (358)..(358): a, c, t, g, unknown or other
  modified_base (390)..(390): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctacctaaactgctcatctcctgggcatccgtaccccgggcaccccggagtcccctgaccgattcagtggcacggcgggtctgggacagacttcnctctcaccatcagcaacctgcaggctagaatntgtggctaagtttatactgtacagtctagttagttgtaggaacgtccgttaccgcttccgtaacgttttccgggggacgggtacgggggacccggtcggggtagggtacgacgttacgaacggtaccgtaaacgttggtacgggccgtacggcctacccgtagttccgtttcggttactttcccg

SEQ ID NO: 408555 - DNA, 660 bp, Homo sapiens
  misc_feature: GZ8MTXP02JOK2S.11.11.A11.1.454.CMB.2.raw
  modified_base (415)..(415): a, c, t, g, unknown or other
tcagcgagagataccacgaccggtgctcgatttagctacgactgcaggggcagcaagatggtgttgcagacccaggtcttcatttctctgttgctctggatctctggtgcctggtgggacatcctgatgacccagtccccagatatcctgcctgtgtctcgtgggcgaggacgggccaccatcgagtgacaagtccagcgagacttctttaatagtagtgtacaacgataaggacttattagcttaggtatcagacaaaacgaggacagcctactaaactgctcatcctcgtgggcagtaccgtaccccgggcaccccgggacgtcccctggacccgtatttcgaggtcggacacgggcggggtcgtaggggacaggtaccttcaccttcgtacacctagtacacgacctaaccngaccgaggcctaggaagtagtggtaggtaccttaaggttttaacttactgttaccgagtacgtaaggttagttaggtacgaagtccctccggtcttacgttaccgtttacggggacgggtacggggtaccccggtcgggttacgggaagtacgtaccgaaagggtaccggtaaaccgttgggttaacgggaaccgttcgggaccctaaacccggtttacgttaccgtttaccgttacctttaccg

SEQ ID NO: 408556 - DNA, 542 bp, Homo sapiens
  misc_feature: GZ8MTXP02GUDQV.11.11.A11.1.454.CMB.2.raw
  modified_base (314)..(314): a, c, t, g, unknown or other
  modified_base (352)..(352): a, c, t, g, unknown or other
  modified_base (384)..(384): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctacctaaactgctcatctcctgggcatcgtacccggcacccggagtcccngaccattcagtggcacggcgggtctgggacagacttcnctctcaccatcagccaacctgacagctgaagntgtggactagtttatatgtcaggtctagttattggtagtaacgccgtccgtctcgtaaccgtttcgggacggggtacggggacccggtcgggtaggagtactacgaacggacgtaacgtggttacgcgtcggacctacctagtcctcgttacttaccg

SEQ ID NO: 408557 - DNA, 535 bp, Homo sapiens
  misc_feature: GZ8MTXP02I5FMS.11.11.A11.1.454.CMB.2.raw
  modified_base (258)..(258): a, c, t, g, unknown or other
  modified_base (386)..(386): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaaacgataaggactatttagcttggtatcagacaaaaaccnggacagcctacctaaactgctcatctcctgggcatctacccggcacccggagtccctgaccgattcagtggcaggcggtcgtgggacagacttcactctcaccatcagccaacctgcaggctagaagntgtggactagtttatactgtcagctagttattgtagaagtcctccgcttcgtacgtttccggggacgggacgggtaccggtcgggtaggagacgtacgaacggtacgaacgtggtacggccgtcggcctacgtactctcgttcttaccg

SEQ ID NO: 408558 - DNA, 511 bp, Homo sapiens
  misc_feature: GZ8MTXP02FJX9I.11.11.A11.1.454.CMB.2.raw
  modified_base (334)..(334): a, c, t, g, unknown or other
  modified_base (380)..(380): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctacctaaactgctcatctcctgggcatctacccggcacccggatccctgaccgattcagtgcagcgggtcngggacagacttcactctcaccatcagcaacctgcagctagagatgnggctagtttatactgtcagcagtattgtagaagctccgctctacgtttcgggcggtagggacccggcgggtggagtacgtacgaacggacgaacgtggtacggcgtcggcctaccgattctcgttcttacc

SEQ ID NO: 408559 - DNA, 524 bp, Homo sapiens
  misc_feature: GZ8MTXP02G2FPA.11.11.A11.1.454.CMB.2.raw
  modified_base (259)..(259): a, c, t, g, unknown or other
  modified_base (314)..(314): a, c, t, g, unknown or other
  modified_base (320)..(320): a, c, t, g, unknown or other
  modified_base (378)..(378): a, c, t, g, unknown or other
  modified_base (395)..(395): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttaatatagtgtcaacgataaaggacttatttagcttggtatcagacaaaaaccnggacagcctacctaaactgctcatctcctgggcactctaccccgggcaccccggngtcccngaccgattcagtggcaggcgggtctgggacagacttcactctcaccatcagctaaacngcaaggctagaagatgnggtactaagtttattactggtacagatagttattgtagaaagctccgcttctacgtttcggcgggtaggggaccggcggtaggagacgtcgaacgacgaactcggtgcgtgaccacatctcgtcttacc

SEQ ID NO: 408560 - DNA, 538 bp, Homo sapiens
  misc_feature: GZ8MTXP02J15UD.11.11.A11.1.454.CMB.2.raw
  modified_base (306)..(306): a, c, t, g, unknown or other
  modified_base (315)..(315): a, c, t, g, unknown or other
  modified_base (331)..(331): a, c, t, g, unknown or other
  modified_base (346)..(346): a, c, t, g, unknown or other
  modified_base (382)..(382): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggacttattagcttggtatcagcaaaaaccaggacagcctacctaaactgctcatctcctgggcatcacccggcacccggnccctgaccnttcagtgcaggcggtntggggacagacttcncctctccacatcaagccaacctgcaggctagaaagntcggtgactagtttattactgtcagctaggttattgtgaagctaccgctacgtacgtttcggggcgaaggggtcccggcgggtacggagacgtacgaacggtacgacggttcggtacggccgtacgacctaccgtacgttccgttacgttcctacg

SEQ ID NO: 408561 - DNA, 583 bp, Homo sapiens
  misc_feature: GZ8MTXP02HBJD5.11.11.A11.1.454.CMB.2.raw
  modified_base (210)..(210): a, c, t, g, unknown or other
  modified_base (260)..(260): a, c, t, g, unknown or other
tcagcgagagataccacgaccggtgctcgatttagctacgactgcaggggcagcaagatggtgttgcagacccaggtcttcatttctctgttgctctggatctctggtgcctggtggggacatcctgatgacccagtccccagatatcctgcctgtgtctctgggcgagagggccaccatcgagtgcaagtccagcgagacttcttttanatagtgtcaaacgataaggacttatttagcttggtatcagacaaaaaccnggacagcctactaaactgctcatctctggcatcctacccggcacccggatccctgaccgtatcaggtcgcacggtcggtctaggacagacttcgactctacacatcagacaactgacaggctagaagagtgtaggcttaaggtttactacgtgtacgaagtaccgtaagttagttgtaggaacgtccgtaccgtccgttacgtaaccggtttcggggaccgggtacggggtaccccgggtcgggtacgagtacgtacgaacggtaaccgtacgtcggtacggtcgtacgtaccgtacgtacgttccgttacgttacgttaccg

SEQ ID NO: 408562 - DNA, 580 bp, Homo sapiens
  misc_feature: GZ8MTXP02GLRP9.11.11.A11.1.454.CMB.2.raw
  modified_base (400)..(400): a, c, t, g, unknown or other
  modified_base (404)..(404): a, c, t, g, unknown or other
  modified_base (439)..(439): a, c, t, g, unknown or other
  modified_base (446)..(446): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagagggccaccatcgagtgcaagtccagcgagacttcttttatatagtgtacaaacgataaaggacttattagcttggtatcagacaaaaccaggacagcctacctaaactgctcatctcctgggcactccgtaccccggcaccccggactcccctgacccgtattcgagtggcaggcgggtctagggacagtaccttcacctctacaccatcagccaacctgcaggctagaanatgngctagtttatactgtacagctagttatagtagaanccgtccncttacgtacgttcgggacgggacggggacccggtcgggtaggaagtacgtaccggaaagggtaccgtaaacggtcggttacggccgttacggacctaaccccggtatttccgtaccggtttccttttaaccccg

SEQ ID NO: 408563 - DNA, 561 bp, Homo sapiens
  misc_feature: GZ8MTXP02GIC2A.11.11.A11.1.454.CMB.2.raw
  modified_base (209)..(209): a, c, t, g, unknown or other
  modified_base (261)..(261): a, c, t, g, unknown or other
  modified_base (362)..(362): a, c, t, g, unknown or other
  modified_base (376)..(376): a, c, t, g, unknown or other
  modified_base (412)..(412): a, c, t, g, unknown or other
  modified_base (452)..(452): a, c, t, g, unknown or other
  modified_base (493)..(493): a, c, t, g, unknown or other
  modified_base (547)..(547): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagacgggccaccatcgagtgcaagtccagcgagacttcttttanatagtgtcaaacgataaggactatttagctttggtatcaagacaaaaaaccnggaacacgaccctacctaaaactgacctcatcctcctgggcactccgaccccggccaccccggacgtcccgtgaccgtattccgagtggcacggcggtcgngggacagaccttcnctctcaccatcagcaacctgcagctagaagtgtagnggtactaagtttatacgtgtacagtcagttattgagaacnccctaccgtcttcgtacgtttcgggacgggtacggacccgnggggtagagtaccgtgaaacgaccgtaacgtggagaacccgttcacctaccgtntcgttcgttcttac

SEQ ID NO: 408564 - DNA, 510 bp, Homo sapiens
  misc_feature: GZ8MTXP02IGUDE.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggatatttagcttggtatcagcaaaaaccaggacagcctacctaaactgctcatctcctgggcatcctacccgggcaccccggacgtccctgaccgattcgagtggcacgcgggtctggggacagacttcactctcaccatcagcaacctgacaggctagaagatgtggctaagtttatactgtacagctagttattcgtagaagtctccgctacacgtttcggcggtagggaccgcgggtaggagactcgaagacgactgtacgctgacacatcctgtacttcg

SEQ ID NO: 408565 - DNA, 546 bp, Homo sapiens
  misc_feature: GZ8MTXP02G64OQ.11.11.A11.1.454.CMB.2.raw
  modified_base (255)..(255): a, c, t, g, unknown or other
  modified_base (350)..(350): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttctttatatagtgtacaacgataaggactatttagcttggtatcagacaaaaccnggacagcctactaaactgctcatctcctgggcatccgtacccggcacccggatccctgaccgattcagtggcaggtcgggtctgggacagactcnctctcaccatcacgacaacctgcaggctagaagtgtgtgctaagtttatacgtgtacagctagttagttgtagaacgtccgtaccgtcgtcgtacgtttcgggaccgggtacgggacccggtagggtacgggagacgtaccgacggtaccgaacgttggtcggcgtcgaccgtaaccagttcctcggttcttaccg

SEQ ID NO: 408566 - DNA, 608 bp, Homo sapiens
  misc_feature: GZ8MTXP02J1377.11.11.A11.1.454.CMB.2.raw
  modified_base (253)..(253): a, c, t, g, unknown or other
  modified_base (343)..(343): a, c, t, g, unknown or other
  modified_base (401)..(401): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccacgtccccagatatcctgcctgtgtctctgggcgagaggccaccatcgagtgcaagtccagcgagacttctttatatagtgtcaacgataaggactatttagcttggatcagacaaaaccnggacagcctacctaaactgctcatctaccgtgggcatccgtaccccgggcacccggagtccctggaccgattcgagtcggcagccgggtnggacagtcttcgactctccgaccatctacgaccaacccgtgcgaaggcttacgaagtntggtagaccgttatttagtaccgtgactagacgtagttattggacgtaaacgtccgtccgtacgtacggttaaccggtttccggggacgggacgggggtaaccccgtcggggtagggtaacgtaccgttacggaacggtacccggtaacgttcggtacggggtccttacggacccgtaacctacgttccgtttacggtctttacccg

SEQ ID NO: 408567 - DNA, 554 bp, Homo sapiens
  misc_feature: GZ8MTXP02FRFSB.11.11.A11.1.454.CMB.2.raw
  modified_base (254)..(254): a, c, t, g, unknown or other
  modified_base (399)..(399): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactattagcttggtatcagacaaaaccnggaacagcctacctaaactgctcatctcctggcatccgtacccggcacccggacgtcccctgaccgattccgagtcggcacggcgggtctaggggacagtacttcacctctacaccatcacgccaacctgcaggctagaagatgnggtactagtttatactgtacagcagttattggtagaagtcctccgactcgtaccgtttcgggacgggtacggggaccgtcgggtaggacgtagtaccgaagtaccggaacgttggtacgggctcggaccaacctagtcgttacgttctttaaccg

SEQ ID NO: 408568 - DNA, 531 bp, Homo sapiens
  misc_feature: GZ8MTXP02FIZFU.11.11.A11.1.454.CMB.2.raw
  modified_base (389)..(389): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctacctaaactgctcatctcctgggcatctacccggcaccccggagtcccctgacccgattcagtggcagcgggtctgggacagaccttcactctcaccatcagcaacctgcaggctgaagatggnggctagtttatactgtcagctagttatgtagaagctccgctcgtacgtttcgggacgggtacggggaccgtcgggtggagacgtcgaacggtaccgaaacgtggtacgggctcggaccaccgtactcgtcggtcctttaccg

SEQ ID NO: 408569 - DNA, 578 bp, Homo sapiens
  misc_feature: GZ8MTXP02H9QKV.11.11.A11.1.454.CMB.2.raw
  modified_base (418)..(418): a, c, t, g, unknown or other
  modified_base (443)..(443): a, c, t, g, unknown or other
  modified_base (511)..(511): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaaacgataaggacttatttagcttggtatcagacaaaaccaggacacgccctaccaaactgctcactctccgtgggcactccgtaccccgggcaccccggagtcccctgaccgattcgaggtcggcacggcggggtcgtcgggactaggtccttcacctctacacctatcagacctaacttcgacaaggtctagaaagtntcgggtagacttaagtttattacgngtacgagtctagttatggtagaagtcctcgactctacggtttcggacgggacgggaccgtgggggtanagtactacgacgtaaccgtacgttggcgaacgttcgaccctaacggtcttcggtactttccttaccg

SEQ ID NO: 408570 - DNA, 616 bp, Homo sapiens
  misc_feature: GZ8MTXP02G5ZAX.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggactatttagcttgttatcagacaaaaaccaggacagcctacctaaactgctcatctccgtgggccatccgtaccccgggcaccccgggtacgtcccctagaccgtacttcgagtcggcaggccggtcgtgggacagtaccttcactctacaccatcacgcaaccctgactacggctagaagtagtggtcggacttaagtttactacgttggtacctaggtactaaggtttattggttacgaaacgtcccgtcccgtacgttaccgtaccgggttttaccggggaccggggtaacggggcccggtacggggttacgggacgtacgtacggaacggtacgtaaacgttggtcggaacgttcgacccacgtacttccgttcgttactttccg

SEQ ID NO: 408571 - DNA, 599 bp, Homo sapiens
  misc_feature: GZ8MTXP02FQZ1C.11.11.A11.1.454.CMB.2.raw
  modified_base (402)..(402): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctacctaaactgctcatctcctgggcatctacccgggcaccccggacgtcccctgaccgtattccagtggcacggtcgggtctaggggacagacttcactctcaccactcagtccaacctgcaggctaggaagtatggnggtacttaagttttattaaccgtgttaccaggtactaaggttagttggtagaacgtccttccggcttaccgtacggtttcggggaccgggtacggggacccggtcggggtagggaacgtacgttacgaacggtaacccggtaacgtggttacgggcttacggaccacccgtaagttccgttacggttcctttacccg

SEQ ID NO: 408572 - DNA, 613 bp, Homo sapiens
  misc_feature: GZ8MTXP02GDBG9.11.11.A11.1.454.CMB.2.raw
  modified_base (262)..(262): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgacaagtccagcgagtacttcttttatatagtgtacaacgaataaggtactatttagcttggtatcagacaaaacgngacacgcctactaactgctcatcctcgtggcatccgtacccggcacccggactcccgtcgaccgtacttcgaggtcggcacggtcgggtcgtgggacacgtaccttccaccttccaccaaccacgtaccaacggaccctaaacccgttcgaccgacggtaccgttaaggaaagtagttcgggtaccgtaacgtttaaggttttaactaacgttcgtacgagtactagttagtgtagactccgtcgtctcgtacgtttcggggacggtacgggcccggtacgggagtagactacggacggtacgtaacggttcgggcgtcgacgtacctacgtacgtcgttcgttacttacg

SEQ ID NO: 408573 - DNA, 595 bp, Homo sapiens
  misc_feature: GZ8MTXP02HRUQA.11.11.A11.1.454.CMB.2.raw
  modified_base (288)..(288): a, c, t, g, unknown or other
tcagcgagagataccacgaccggtgctcgatttagctacgactgcaggggcagcaagatggtgttgcagacccaggtcttcatttctctgttgctctggatctctggtgcctggtggggacatcctgatgacccagtccccagatatcctgcctgtgtctctgggcgagagggccaccatcgagtgcaagtccagcgagacttcttttatatagtgtacaaacgataaggacttatttagctttggtatcagacaaaaaccaggacagcctacctaaactgctcatcncctgggcatccgtaccccggcaccccggacgtccctggaccgtatcgagtggcaggcgggtctgggacagtaccttcactctccacactcacgcaacctgcaggctagagatggtcgctagtttattactgtacagacgtaagttagttgtacggaacgtcctcccggcttacgtaccggtttcggggaccggggtacggggacccggtcggggtagggaacgacgtaccggaacggtaacccgtaaacgtgggtacggtcgttacggacctaacccgtacgtttccgttcgtttacctttaccccg

SEQ ID NO: 408574 - DNA, 509 bp, Homo sapiens
  misc_feature: GZ8MTXP02I5JUM.11.11.A11.1.454.CMB.2.raw
  modified_base (208)..(208): a, c, t, g, unknown or other
  modified_base (281)..(281): a, c, t, g, unknown or other
  modified_base (389)..(389): a, c, t, g, unknown or other
  modified_base (421)..(421): a, c, t, g, unknown or other
  modified_base (429)..(429): a, c, t, g, unknown or other
  modified_base (500)..(500): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtcaacgataaggactattagcttggtatcagacaaaaccaggacagcctctaaactgctcatctccngggcatcctaccccgggcacccggacgtccctgacccgtattcaggtggcaggccggtcgtgggacagaccttcactctcacatcagtcaacctgcaggctagaaagntgtgacttagtttatacgtgtacagtcagttnttgtgaancctcgctcgtacgttcggacgggtagggcccgtcggtggagctacgagtacgagtgtaggctgctaccgtntcgtctctc

SEQ ID NO: 408575 - DNA, 547 bp, Homo sapiens
  misc_feature: GZ8MTXP02JQ5QI.11.11.A11.1.454.CMB.2.raw
  modified_base (208)..(208): a, c, t, g, unknown or other
  modified_base (256)..(256): a, c, t, g, unknown or other
  modified_base (389)..(389): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtcaacgataaggactatttagcttggtatcagacaaaaaccnggacagcctacctaaactgctcatctacctgggcactcgtacccgggcaccccggagtcccctgaccgattcagtcggcacggcgggtctgggacagacttcactctcacatcagcaactgcaggctagaagntagtgactagtttatacgtgtacagactagttagttgtagaacgtcctccgactcgtacgtttccgggacgggtacgggacccggcgggttaggacgacgtcgaacggtaccgtaacgtggtacggctcggaccgacctattccgtacgttctttacc

SEQ ID NO: 408576 - DNA, 648 bp, Homo sapiens
  misc_feature: GZ8MTXP02GPDA2.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgacaagtccagcgagtacttcttttatatagtgtacaaacgataaggacttatttagcttggtatcagacaaaaccaggacacgcctacctaaactgctcatcctccgtgggcactccgtaccccggccacccggacgtcccgtcgaccgtattcgagtcggcgacggcgggtcgtaggggacacggtaccttcacctcctaccaccactaccacgaccaaaccgtgacgtaggacgtaagaaagtagtggtacgacgttaagtttattaccgtgttaccgagtacgtaagtttagttacggtagaacgtcccgtaccgtacgttacccgttaccgggtttccgggaccggggtacgggggtacccggtacggggttacggaagtaccgtaccgaaacgggtaccgtaacgttcggttacggccgtacgacccgaacctagttccgttcgttacctttacccg

SEQ ID NO: 408577 - DNA, 651 bp, Homo sapiens
  misc_feature: GZ8MTXP02JYN6X.11.11.A11.1.454.CMB.2.raw
  modified_base (209)..(209): a, c, t, g, unknown or other
  modified_base (420)..(420): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgactcagtccccagatatcctgcctgtgtctctgggcgagacgggccaccatcgagtgcaagtccagcgagactcttttanatagtgtacaacgataaggactattagcttggtatcagacaaaacaggacagcctacctaaactgcctcatctccgtgggcagtccgtacccgggcacccggactcccgtagaccgattccaggtcggccaggcgggtcgtggggacacggcttccaacgtctaccacatcgacgtacccaaaccgtcgacgtaacggctaaggtaaacgngttggggtaacggtacgtttaaggttttaacttaaccgttgggtactaacggtactaaggttattagggttaacgggaaactcccgttccgggtacttccgtaccgggtttcggggaccggggtaacgggggtccccggtacgggggttacggaaggttaccgtaccggaaggtaccggtaaacggtgggtaacggccgtacggactacctacggttccgttgttaccccg

SEQ ID NO: 408578 - DNA, 523 bp, Homo sapiens
  misc_feature: GZ8MTXP02IPIVI.11.11.A11.1.454.CMB.2.raw
  modified_base (256)..(256): a, c, t, g, unknown or other
  modified_base (377)..(377): a, c, t, g, unknown or other
  modified_base (389)..(389): a, c, t, g, unknown or other
  modified_base (421)..(421): a, c, t, g, unknown or other
  modified_base (430)..(430): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagactcttttatatagtgtcaacgataaggacttatttagcttggtatcagacaaaaaccnggacagcctactaaactgctcatctcctgggcatctaccccggcaccccggactccctgaccgtattcgagtggcacggcgggtctcggggacagacttcactctcaccatcagcaacctnccagctagaagntgtggctaagtttatactgtacagctaagttnttgtagaanctccgctacctacgtttcgggacgggtagggaccgtcggtaggagactacgaggaccgaacgtggtacgctcgaccacgatctcgttacttcc

SEQ ID NO: 408579 - DNA, 546 bp, Homo sapiens
  misc_feature: GZ8MTXP02ISWI2.11.11.A11.1.454.CMB.2.raw
  modified_base (353)..(353): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggactatttagcttggtatcagacaaaaaccaggacagcctacctaaactgctcatctcctggcatcctacccgggcacccggatcccctgaccgtattcagtggcagcgggtctgggacagacttcnctctcaccatcagcaacctgcaggctagaagatgtgctagtttatactgtcagtctagttattgtagaacgtcctcccgtcttccgtacgtttcggggacggggtacggggtacccggtcgggtgggaagtacgtacgacggaaccgtaacgtggtcggtcgtcggacctaccgtatccgttcgttctttacc

SEQ ID NO: 408580 - DNA, 668 bp, Homo sapiens
  misc_feature: GZ8MTXP02JWC1V.11.11.A11.1.454.CMB.2.raw
  modified_base (390)..(390): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgaggagggccaccatcgagtgcaagtccagcgagacttctttatatagtgtacaacgataaggtactatttagcttggtatcagacaaaacaggacagcctacctaactgctcatcctccgtgggcacgtccgtaccccggccgaccccggtacgtcccgtcgaccgtacttacgaggtcggacgacgggccggggtacgtcggggaacacggtacctttaccncctcctaccaaccactaccgacgaccaaacccgtgaccgtacggtcgtaaggaaagtacgtggtcggtacgtttagttttacttacgtacgtacgagtacgtaagttacgttagtacggtaacgtcccgtaccgtaccgttaccgttacggtttccgggggacgggaaccggggtaccggtacgggggtacggaaggtacgtaccggtaaacggtaaccgtaacggttcggtacgtccgtacggaccctacgtacgtttccgtacgttcctttacccg

SEQ ID NO: 408581 - DNA, 524 bp, Homo sapiens
  misc_feature: GZ8MTXP02GQVJL.11.11.A11.1.454.CMB.2.raw
  modified_base (398)..(398): a, c, t, g, unknown or other
  modified_base (401)..(401): a, c, t, g, unknown or other
  modified_base (414)..(414): a, c, t, g, unknown or other
  modified_base (469)..(469): a, c, t, g, unknown or other
  modified_base (500)..(500): a, c, t, g, unknown or other
tcagcgagagataccacgaccggtgctcgatttagctacgactgcaggggcagcaagatggtgtgcagacccaggtcttcatttctctgttgctctggatctctggtgcctgtggggacatcctgatgacccagtcccagatatcctgcctgtgtctctgggcgagagggccaccatcgagtgcaagtccagcgagacttcttttatatagtgtcaaacgataaggactatttagcttggtatcagacaaaaaccaggacagcctacctaaactgctcatcctcctgggcatccgtaccccggggcaccccggatcccctagaccgattcaggtggcacggcgggtctggggacagtacttcactctcaaccatcaagccaaacctgcaggctagaantgngctagtttatacngtacagtcagttattgagaagcctccgctcgtacgtttcgggcggaagggcccgngggtagagactcgaaggacgtaactgtcggntcgacacctatctcgttcttaccg

SEQ ID NO: 408582 - DNA, 614 bp, Homo sapiens
  misc_feature: GZ8MTXP02I0J1Z.11.11.A11.1.454.CMB.2.raw
  modified_base (208)..(208): a, c, t, g, unknown or other
  modified_base (253)..(253): a, c, t, g, unknown or other
  modified_base (346)..(346): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttanatagtgtcaacgataaggactattagcttggtatcagacaaaacnggacagcctctaaactgctcatctctgggcatcctacccggcacccggatccctgaccgtattcagtggcaggcggtctgggacagaccttcnctctcaccatcagcaacctgcaggctagaagatgtaggtctagttttatacgtgttaccaggtccagtttaattggtagtaaacgcccgttaccggaccttcgtaacccgttttcgggggaccgggtacgggggtaacccccggtcgggggtacggtaaagggaacgtttaccggaaaacggtaccgggtaaaaccgtttgggttcgggaaccggttacgcccggtaaaacccgttctttaccgtttacggtttccgtttttaacccg

SEQ ID NO: 408583 - DNA, 565 bp, Homo sapiens
  misc_feature: GZ8MTXP02HQQHM.11.11.A11.1.454.CMB.2.raw
  modified_base (347)..(347): a, c, t, g, unknown or other
  modified_base (352)..(352): a, c, t, g, unknown or other
  modified_base (373)..(373): a, c, t, g, unknown or other
  modified_base (466)..(466): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagaggccaccatcgagtgcaagtccagcgagtacttctttatatagtgtacaacgataaggtacttatttagcttaggtatcagacaaaaccaggaacagcatacctaaactgctcatcctcgtgggacactccgtaccggcaccccggatccctagacgattcgagtggccaggcggtcnggacncgacttcactcacaccatcanccaactgaccgtaggactaggaacgtagtggtacgtacttaagttttactacgttcggtactagtacgtagttactggtacgaagtccgtccncgttcgtacggttcggggacgggtacggggccgtcggtggaacgtacgtacgaacggtaccgtacgtggtcggcttacggcaactcgttcgtctttccc

SEQ ID NO: 408584 - DNA, 607 bp, Homo sapiens
  misc_feature: GZ8MTXP02HY0IG.11.11.A11.1.454.CMB.2.raw
  modified_base (354)..(354): a, c, t, g, unknown or other
  modified_base (379)..(379): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttatatagtgtcaacgataaggactatttagcttggtatcagcaaaaccaggacagcctaccaaatgctcatctccctgggcatcctacccgggcaccccggagtccctgaccgattcagtggcacggcgggtctggggacaggacttcncttctcaccatcacgacaaacccgngacaggctagaaagtgttaggtagtacttaagtttacttacgtgtacagtacgtaagtttagtagtacggaacgtccgtaccgtacttaccgtaccggtttccggggaccgggaacgggggtacccggtcggggtacgggaaacgtacgtaccggaacggtaaaccggtaacgttcgggtaccggtcgtacggaccctacccgtagtttccgtacgtttacccttacc

SEQ ID NO: 408585 - DNA, 569 bp, Homo sapiens
  misc_feature: GZ8MTXP02JSAC6.11.11.A11.1.454.CMB.2.raw
  modified_base (311)..(311): a, c, t, g, unknown or other
  modified_base (316)..(316): a, c, t, g, unknown or other
  modified_base (345)..(345): a, c, t, g, unknown or other
  modified_base (352)..(352): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaacgataaggactatttagcttggtatcagacaaaaaccaggacagcctacctaaactgctcatctcctgggcatccgtacccggcacccggntcccngaccgattcagtgcagcgggtctgggacngacttcnctctcaccatcagccaaacctgcaggctagaagtatgtggctaagtttacttactgttacagtactagttattgtagaagtccgttaccggaccttacgtacgttttccgggggacgggtaacggggaccccggtggggtacggaggtacgttacgaaggtaaccgaaccgttggtacggtccgtggccctaacctagttcctttgtacctttaccc

SEQ ID NO: 408586 - DNA, 767 bp, Homo sapiens
  misc_feature: GZ8MTXP02JATOE.11.11.A11.1.454.CMB.2.raw
  modified_base (739)..(739): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatcgacccagtccccagatatcctgcctgtgtctcgtgggcgagacgggccaccatcgagtgacaagtccagcgagtacttctttatatagtgtacaaacgataaggtacttattagtcgttggtatacgaagaaccaaaaaccgaggaaccacggtacccctaacccttaaacgtcgtacctactactccgttcccgtggggtacctacgtccccggtaacccccggggccgtaaccccgggtaccgtccccgtacggacccgttacgttcgaggtcgggccgacgggtccggggtcgtacggggaacctacggtaccctttccacccgttaccttacccaaccctacgttacccgacgtaaccccgtaaacccgttccgaacggtaccggtacgtaaggaaacggttagttcgggtacgtacgtttaagttttacgttaccgtgttacgacgtacttaggtttagtacggttacgaacgtccgttacccgtacttacggtaccgtttccgggggacggggtacccggggacccggtggggtacggaaacggtcgttaacggaaacggttacgtaacggtggtccgggtaacgttccggaaccttaaccggtnttcccgttacgtttacccgtttaacccg

SEQ ID NO: 408587 - DNA, 661 bp, Homo sapiens
  misc_feature: GZ8MTXP02HMYPQ.11.11.A11.1.454.CMB.2.raw
  modified_base (207)..(207): a, c, t, g, unknown or other
  modified_base (256)..(256): a, c, t, g, unknown or other
  modified_base (309)..(309): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagaggccaccatcgagtgcaagtccagcgagacttcttttanatagtgtacaacgataaggacttatttagcttggtatcagacaaaaccnggacagcctaccaaactgctcatcctctgggcactccgtacccggcacccggntccctgaccgtattcgaggtcggcgacggtccgggtacgtaggggactaggtacctttcaccttcctacacctataccgacgacctaacccgtgacacggtctaggaaagtagtggtcggtacttaacgttttacttaccgtgtacgtacgtctaagtttaagttgtacggtaacgtaccgttcccggtacttacccgttaccggtttaccggggacggggtaaccggggaccccgggtaggggttaaccgggaaggtacgttaccggaaacggtaaccggtaaaccgttgggtaccgggtaacttccggaacccgtaccgtaacttccgttaacggtttccctttaacccg

SEQ ID NO: 408588 - DNA, 581 bp, Homo sapiens
  misc_feature: GZ8MTXP02IS3LC.11.11.A11.1.454.CMB.2.raw
  modified_base (257)..(257): a, c, t, g, unknown or other
  modified_base (286)..(286): a, c, t, g, unknown or other
  modified_base (360)..(360): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggacttattagcttggtatcagacaaaaaccnggacagccctactaaactgctcatctccngggcatccgtaccccggcaccccggacgtcccctgaccgtattcagtggcaggccgggtctgggacagacttcnctctcaccatcagcaactgcagctagaagatgtgctagtttatactgtacagtactagttattgtagaagtcctcgctcgtacgtttcggaccgggtacgggaccggtcgggtacgggaggtactaccggtaaacggaaccggtaaaaccgttcgggttaacgggtccgttaccggaccggtaaccctaagtttcccgtttacggttccctttttaacccg

SEQ ID NO: 408589 - DNA, 668 bp, Homo sapiens
  misc_feature: GZ8MTXP02F9X7M.11.11.A11.1.454.CMB.2.raw
  modified_base (208)..(208): a, c, t, g, unknown or other
  modified_base (258)..(258): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagaggccaccatcgagtgcaagtccagcgagtacttcttttanatagtgtacaacgataaggactatttagcttggtatcagacaaaaaccgnggacagcctactaaactgctcatctccgtgggcacgtccgtaccccggaccacccggacgtccctacgaccgtattcgaggtcggcgacgggtccgggtcgtacggggaactacggtaccctttcgaccttctaccacctacgtaccacgaccaaaccgttcgacgtacggacgtaaggtaaagtagttggtacggggtacctttaaggttttaacttacgtagttaccgtaaggaccgttaaggttagtttaggtacgggtaactcccgttccgttaccgttaccgtaccggtttacgggccggggtacggggtacccggtagggttacgggaaagtcgtaacggaacggtaaccgtaaccgtggttacggcgttaccgacggtactacgttcgtcgttacctttaccg

SEQ ID NO: 408590 - DNA, 550 bp, Homo sapiens
  misc_feature: GZ8MTXP02GFHK6.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggactattagcttggtatcagacaaaaccaggacagcctacctaaactcgctcatctcctgggcatctacgtcggcacccggactccctgaccgattcaggtcggcgacggcgggtcgtcgggacagtacttcgacttctacacctatcagccaaacctgacaggctagagatgtgtctagtttatactgtcagctagtattggtacaacgtcctcggtctcgtcgttacgggcgggacgggtaccgtcgggtcggaagtacgtacgacggaacccgtagtacggtcggtcgtacggacctaccgtacttccgttacggtttccc

SEQ ID NO: 408591 - DNA, 666 bp, Homo sapiens
  misc_feature: GZ8MTXP02H734R.11.11.A11.1.454.CMB.2.raw
  modified_base (210)..(210): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagacttcttttanatagtgtacaacgataaggacttattagcttggtatcagacaaaaaccgaggacacgcctacctaaactgctcactcctcgtgggcacgtcccgacccgggcacccggactcccgtagaccgtattcgaggtggcgacggtcgggtctggggactagtaccttcaccttctaccgaaccctactaccgaacgtacctaaaccccgttagaccgacgggtactaggaaaacggtcgttaggttacggtacgttaacgtttaacttacgtacgtacgagtacgtagtttagtttagacggtaacgtccgttaccgccgtttccgtaacgggttttccgggggaccgggtaacgggggtacccccgggtcggggtagggtaaacgtacggtaaccgaaacgggacgtaacgttgggtacgaacgtcgaccgtaacctcgttcgttcgttacctttaccg

SEQ ID NO: 408592 - DNA, 702 bp, Homo sapiens
  misc_feature: GZ8MTXP02HA5Y4.11.11.A11.1.454.CMB.2.raw
  modified_base (266)..(266): a, c, t, g, unknown or other
  modified_base (426)..(426): a, c, t, g, unknown or other
  modified_base (436)..(436): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgaggacgggccaccagtcgagtcgcaacgtccagcgacgtactttcttttatatagtgtacaaacgtataaggacttattagcttggtatcagacaaaacnggacacgccctactaaactgctctatcctccgtgggacctacgttcccgtaccccggggcctaaccccgggtactccccgtaggacccgtatttccgaggttcggacgtacggggtcccggggtacgttaggggaacctacggttaccttccaccttccnccgaaacctntaccaacggacccaaacgtcgacgacgtacgtagaagtgtggtacggtactttaaggtttaacttacgtcggtactaagtacgtagtttagtaaggttacggaaacctcccgttacccgccgtttaccgttaaccgggtttccggggaacggggaacggggtccccggtacggggttaggaaccggtaattacccggaaagtaccggtaaccgttggtacggctacgggacctaacgtacttccgttaacgtttcctttaaccccg

SEQ ID NO: 408593 - DNA, 575 bp, Homo sapiens
  misc_feature: GZ8MTXP02GYZRW.11.11.A11.1.454.CMB.2.raw
  modified_base (362)..(362): a, c, t, g, unknown or other
  modified_base (394)..(394): a, c, t, g, unknown or other
  modified_base (410)..(410): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttatatagtgtcaacgataaggacttatttagcttggtatcagacaaaaaccaggacagcctacctaaactgctcatctccgtgggcatccgtacccgggcaaccccggctcccctgacccgtattcgagtggcacggcgggtctgggacagccttcnctctcaccatcagccaacctgcagctagaagntgtggctagttttaanacgttgtacagtactagttagtgtagaacgtccctaccgcttacgtaccggtttcgggacggggtaacggggcccggtacgggttagggaagtcgtacgaaacggtaccggtaaaccgtgggttacgcgtacggaccgacctacggttccttcgttactttcccg

SEQ ID NO: 408594 - DNA, 498 bp, Homo sapiens
  misc_feature: GZ8MTXP02FGYE0.11.11.A11.1.454.CMB.2.raw
  modified_base (352)..(352): a, c, t, g, unknown or other
  modified_base (385)..(385): a, c, t, g, unknown or other
  modified_base (483)..(483): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgatgcaagtccagcgagactcttttatatagtgtcaacgataaggactatttagcttggtatcagacaaaaaccaggacagccctactaaactgctcatctcctgggcatctacccgggcaccccggatcccctgaccgattcagtggcacgcgggtctgggacagacttcnctctcacatcagcaactgacagctgaagatggngctagtttatactgtcagctagtattgtagaagctcgctcgtactttcgggcggaaggggcccgcgggtaggagtactcgagaccgtaactggtggcngacactatctctctc

SEQ ID NO: 408595 - DNA, 601 bp, Homo sapiens
  misc_feature: GZ8MTXP02I4Q80.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggacttattagcttggtatcagacaaaaaccaggacagccctacctaaactgctcatcctccgtgggcactccgtaccccgggccaccccggacgtcccctgacccgtattcgagtggcacggccggggtcgtaggggactaggtaccttcgacctcctaccaccactccaacgaccaaacccgtgaccgaggctagaagtagtggtcggacttagtttactactgtacagtctagttattgagaacgtccgtccgtctccgtacggtttccggggacggtacgggggtacccgtggggtacggaacgtacgtacggacggtaacgtaacgtggttacggcgttcggactaccgtagttcttcggttacttttacc

SEQ ID NO: 408596 - DNA, 584 bp, Homo sapiens
  misc_feature: GZ8MTXP02GCDDX.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagacgggccaccatcgagtgacaagtccagcgagtacttcttttatatagtgtacaacgataaggacttatttagcttggtatcagacaaaacaggacagccctactaaactgactcatctcctgggcatccgtacccggcaccccggtcgtccctgaccgtattcgagtcggcgacggcgggtcgtaggactacgtaccttcacgtctacaccgactcaacgcctaaccgtgacgacggctagaagtactggtaggtacttaagtttagtacttgtacgtaagtcgttaagttagttagtacggaacgtcccgtccggtacttacgtacgttcgggacgggtacgggaccgtcggacgaggtactcgaaacggtacaacgttgacgtcgtacgctacctagtcctcgtacttaccg

SEQ ID NO: 408597 - DNA, 571 bp, Homo sapiens
  misc_feature: GZ8MTXP02GHWGS.11.11.A11.1.454.CMB.2.raw
  modified_base (275)..(275): a, c, t, g, unknown or other
  modified_base (360)..(360): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccatatatcctgcctgtgtctctgggcgagagggccaccatcgagtgcaagtccagcgagacttcttttatatagtgtcaaacgataaggactattagcttggtatacaaacaaaaacaggacagcctacctaaacngctcatctcgtggcatccgtacccggcacccggtacgtcccctagaccgtattcagtgcacggcggtctgggacagactcactcncacatacagcaacgtgcaggctagaagtagtgtagctaagtttataccgtgtactagctagttattggagaacgtccgtacccgcttcgtacgttccgggacgggaacggggtacccgcggggtagaacgtacgtaaccgagggtaaacgaccgtttaggccgtactaacggaccctaacgaacttcgtttcgtaccctttacgtaacccg

SEQ ID NO: 408598 - DNA, 533 bp, Homo sapiens
  misc_feature: GZ8MTXP02F3409.11.11.A11.1.454.CMB.2.raw
  modified_base (354)..(354): a, c, t, g, unknown or other
  modified_base (386)..(386): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaaacgataaggactatttagcttggtatcagacaaaaaccaggacagcctacctaaactgctcatctcctgggcatcctacccggcacccggacgtccctgaccgattccagtggcaggcggtctgggacagacttcnctctcacatcagcaactgcagctagaagatgngactagtttattactgtacagcagttatgacgaagtccgtaccgctcgtacgtttcgggacggacgggtaccgcgggtggagacgtacgaacggaccgtaaacgtggtacgggctacgacgaacccttagttcgttacgtaccttcg

SEQ ID NO: 408599 - DNA, 551 bp, Homo sapiens
  misc_feature: GZ8MTXP02IXH05.11.11.A11.1.454.CMB.2.raw
  modified_base (255)..(255): a, c, t, g, unknown or other
  modified_base (392)..(392): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggacttattagcttgtatcagacaaaaaccnggacagcctacctaaactcgctcatctcctgggcatcctaccccggcacccggacgtccctgaccgattcaggtcggcacggcgggtctgggacaggtacttcgctcctcaccatcagccaactcgcagctagaagntgtcgctaagtttatactgttacagtactagttagttggtagaaacgtccgtccgtcttacgtacgtttcggggacgggaacgggcccggtcgggtaggagacgtacgaacggacgtaaacgtcggtgggaactcggacacctagtctacgtctttacc

SEQ ID NO: 408600 - DNA, 626 bp, Homo sapiens
  misc_feature: GZ8MTXP02F91QR.11.11.A11.1.454.CMB.2.raw
  modified_base (212)..(212): a, c, t, g, unknown or other
  modified_base (261)..(261): a, c, t, g, unknown or other
tcagcgagagataccacgaccggtgctcgatttagctacgactgcaggggcagcaagatggtgttgcagacccaggtcttcatttctctgttgctctggatctctggtgcctggtgggacatcctgatcgacccagtccccagatatcctgcctgtgtctcgtgggcgagagggccaccatcgagtgcaagtccagcgagtacttcttttanatagtgtacaaacgataaggacttattagcttggtatcagacaaaaccnggacagcctacctaaactgctcatctccgtgggcacgtccgtaccccgggcaccccgggacgtcccctaggacccgtattccgaggtcggcgacgggccgggtcgtacggggacaggtaccttcaccttcctaccacctactaccacgaccaaacctgacaggctagaacgtagtggcgtactaagtttactacgtgtacgagacgtaagttattcggtagtacgtccgttccgtcttaccgttacggtttacggggacgggtacgggggtacccggtcggggtaggacggtactacggaaggtaccggtaacgtgggttacggcgttacggacctaacgtacgttcgttacgttcctttacccg

SEQ ID NO: 408601 - DNA, 619 bp, Homo sapiens
  misc_feature: GZ8MTXP02ISSVP.11.11.A11.1.454.CMB.2.raw
  modified_base (260)..(260): a, c, t, g, unknown or other
  modified_base (374)..(374): a, c, t, g, unknown or other
  modified_base (400)..(400): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccagtcgagtgacaagtccagcgagtacttcttttatatagtgtacaacgtataaggacttattagcttggtatcagacaaaacnggacacgcctacctaaactgctcatcctccgtgggcactccgaccccgggccaccccggacgtcccctgaccgtattcgaggtggcacggcgggtcgtgggactagtaccttcncttctaccaccatccagacctaaccncgacgacggctagaaagtgtaggtcggtacttaaggttttactacgtcgtctacgtacgtagtttagttgtaacggtaacgtcccttccgtacttcggtacgtttcggggcggggtaaaccggggcccgggtagggtaggacgtacgtacggaaacggtaccgaggttcggtacggtccgtcggaacctaccgtacgttcgttaccgttactttacccg

SEQ ID NO: 408602 - DNA, 674 bp, Homo sapiens
  misc_feature: GZ8MTXP02IAU6C.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctggtggggacatcctgatcgacccagtccccagatactcctgcctgtgtctcgtgggcgagacgggccaccatcgagtgacaacgtccagcgagtacttctttatatagtgtacaacgaataaggacttaatttacgcgttaggtatacgaacgaaaccaaaaaccgaggaaccacgaccctaacctaaactcgacctacacttcctccgtcgggctaccgtacccgtaccccgggccaccccggtacgtcccgtacggaccgtattccgaggtcggcgtacgggtccgggtcgtacgggactacgtaccttcacctctaccaacctatccacgacctaaccgtgaccgagtacgtagaagtgtggtacgtattaagtttacgtcgtagtaccgaatacgtaagtttacgtagtagggacctccgtaccgtacttaccggttacggttacggggaccggggtacgggaacccgggtgggtacggagaacgtacggacggtaaaccgtacgttggcggtaaccgtaccggacctaaccgtgtttccgtacgtttaccttacccg

SEQ ID NO: 408603 - DNA, 515 bp, Homo sapiens
  misc_feature: GZ8MTXP02FIBDQ.11.11.A11.1.454.CMB.2.raw
  modified_base (254)..(254): a, c, t, g, unknown or other
  modified_base (359)..(359): a, c, t, g, unknown or other
  modified_base (392)..(392): a, c, t, g, unknown or other
  modified_base (427)..(427): a, c, t, g, unknown or other
  modified_base (504)..(504): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagaggccaccatcgagtgcaagtccagcgagactcttttatatagtgtcaacgataaggactatttagcttggtatcagcaaaaacccnggacagcctcctaaatgctcatctcctgggcatcctacccgggcaccccggatcccctgacccgtattccagtggcagcggggtctggggacagacttcactccncaccatcagccaaacctgcaggctgaagagtgnggctagtttatactgtcagcatattgtagagtccnccgctcgtacgttccgggcgggagggtcccgacggtggaagactcgaagaccgaaacgttgacggtcgtgaccaccntctcgtcctcc

SEQ ID NO: 408604 - DNA, 580 bp, Homo sapiens
  misc_feature: GZ8MTXP02FJ2P7.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctggtgggacatcctgatgacccagtccccagatatcctgcctgtgtctcgtgggcgagacgggccaccatcgagtgacaagtccagcgagacttcttttatatagtgtcaacgataaggactattagcttggtatcagacaaaacgaggacacgcctacctaaactgctcatcctcctgggctacgtccgtaccccggccaccccggacgtccctgaccgtattcgagtggcacggcgggtctgggacagtacttcactctacacatcacgcaactgcgaggctagaagtagtggaggtacttaagtttattaccgtgtaccagtacgtaagttagtttgtagaacgtcccgtccggtacttaccgtacggttccggggacggggtacggggacccggtacgggtaggaacgacgtacgaaacggacgtaacgtggtcgcgttcggaccacgtctcgttcgtctttacc

SEQ ID NO: 408605 - DNA, 706 bp, Homo sapiens
  misc_feature: GZ8MTXP02JIFA3.11.11.A11.1.454.CMB.2.raw
  modified_base (264)..(264): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagacgggccaccatcgagtgcaagtccagcgagacttcttttatattagtgtacaaacgataaggtacttatttagcttggtatcagaacaaaaccnggacagcctactaaactgcctcactcctccgtgggacctacgtcccggtaaccccggggccaccccggggtacgtccccgtacggacccgtatttccgaggttcgggcgacgggtccggggttcgtacggggaactacggtaccctttccgacttcctaccaccctaatccgaacgtaccaacccgtgaccgtacggctagaacgtagttggacggtcttaagttttaatacgtcgttacagtactaaggtttgttgtacgggactccgaccgtcttaccggttacggtttaccgggaccgggggtaacggggaccggtacgggggttacgggaaacgtaccggttaacggaaacggtaaaccggtaaccggtttgggaccggtccggtacggtaccctaaccccggttaatttccgtttaccggtttccgtttaaaccccg

SEQ ID NO: 408606 - DNA, 648 bp, Homo sapiens
  misc_feature: GZ8MTXP02HUB7E.11.11.A11.1.454.CMB.2.raw
  modified_base (205)..(205): a, c, t, g, unknown or other
  modified_base (211)..(211): a, c, t, g, unknown or other
tcagcgagagataccacgaccggtgctcgatttagctacgactgcaggggcagcaagatggtgttgcagacccaggtcttcatttctctgttgctctggatctctggtgcctggtggggacatcctgatgacccagtccccagatatcctgcctgtgtctctgggcgagagggccaccatcgagtgcaagtccagcgagtacttnttttanatagtgtacaaacgataaggctatttagcttaggtatcagacaaaacagacagcctacaatgctcatctctgggcactccgtacccggcacccggatccctgaccgattccgaggtcggcacgggtccgggtcgtcgggacaggttaacccttcgaccttcctaccaaccccagttaccaacggtacctaaacccgtgaccgtaggacttaaggaaacgtgttaggtcggtactttaaagttttacgtttaccgtaggtacctaggtacgttaaggtttagttggtaacgggaacgtccgtccccgtcgttaccgtaaccggtttccgggggacgggtacggggtacccgggtcgggtaagggagtaacgtcggaaacggaaccgggtacgttggcggtaacgtcggacctaccgattccgtttcgtttactttccg

SEQ ID NO: 408607 - DNA, 636 bp, Homo sapiens
  misc_feature: GZ8MTXP02JRP3S.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagacgggccaccatcgagtgcaagtccagcgagacttcttttatatagtgtacaaacgataaggacttatttagcttggtatcaagacaaaaccgaggacagcctaccaactgctcactctctgggctactaccgtacccgggccaccccgggacgtcccctggtaaccgtacttccgaggtcggacgaccggggtccggggtcggtacggggacctacggtacctttaccacccttccgttaacccaaccctattaccgaacggtaacccaaacccgttcgacccgaggtcctagggaaacgtagtggtacggcttaaagtttcttacgtgtacgagtacgtagttattggtagtaacgtctaccgtctcgtacgttcgggacgggtacgggacggtcgggtaggaggtacgtacgacggtaccgaactcggtacggcgtacgcgacctgtccttcgttactttacccg

SEQ ID NO: 408608 - DNA, 690 bp, Homo sapiens
  misc_feature: GZ8MTXP02GMKPL.11.11.A11.1.454.CMB.2.raw
  modified_base (288)..(288): a, c, t, g, unknown or other
  modified_base (297)..(297): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatcgacccagtccccagatatcctgcctgtgtctcgtgggcgaggacgggccaccatcgagtgacaagtccagcgagtacttcttttatagttagtgtacaaacgataaggacttatttagcttggtatcagacaaaacaggacacgacctactaactgactnactcctcgngggcacgtaccgtaccccgggacgtaccccgggtactccccgtacgaccgtattcgaggtcggcgacgggtcggggtacgtagggacacggtaccttacaccttccaccaacctataccacgaccctaaaccgtgaccgaaggtccgtaaggaagtaagttgggacgggttactttaagggtttttaacttaccgtacgtttaaacgaccgttagttacggtttaagtttacgggtaacggtaacgtccccgttcccggtactttaccggttacccggtttcgggggacgggtaccgggggtaacccggtgggttacggagtaacgtaccgaacggtaccgtacggtggcggtaacgacggacctacctagttccgttacttccgtttaaccg

SEQ ID NO: 408609 - DNA, 636 bp, Homo sapiens
  misc_feature: GZ8MTXP02H6XEC.11.11.A11.1.454.CMB.2.raw
  modified_base (186)..(186): a, c, t, g, unknown or other
  modified_base (212)..(212): a, c, t, g, unknown or other
  modified_base (459)..(459): a, c, t, g, unknown or other
  modified_base (464)..(464): a, c, t, g, unknown or other
  modified_base (475)..(475): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtnacaagtccagcgagtacttcttttanatagtgtacaacgataaggacttatttagcttggtatcaagaacaaaaccgagacacgtaccctaacctaaactcgacctacacttcctccgtacgggactaccgtaccccggtaaccccgggccgtaaccccgggtaccgtcccggtacggtaaccgtcgtacgacgggtcggacgtcccggggtcgggttacggtacggactacgtaccttccaccgttcctaccacctacaccgacgactaccngacgngtcgagaacgngttggtacgtatttacgttattcgtgaccgtgtagttagtttagtgacgtacgtccgtacctcgttaccgtcgggttcgggacgggtacggggccggtgggagtagacgacggacgaacgtcgtggtcgcgtcgaacctactcgtttccgtctttactccc

SEQ ID NO: 408610 - DNA, 510 bp, Homo sapiens
  misc_feature: GZ8MTXP02H9PYO.11.11.A11.1.454.CMB.2.raw
  modified_base (208)..(208): a, c, t, g, unknown or other
  modified_base (282)..(282): a, c, t, g, unknown or other
  modified_base (386)..(386): a, c, t, g, unknown or other
  modified_base (428)..(428): a, c, t, g, unknown or other
  modified_base (487)..(487): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccacatcgagtgcaagtccagcgagacttcttttanatagtgtacaacgataaggacttatttagcttggtatcagacaaaaaccaggacagcctcctaaatgctcatcncctgggcatccgtacccggcacccggatcccgtgaccgattccagtgcagcgggtctgggacagacttcactctcaccatccagcaaacctgccaggctagagntgtggctagtttatactgtcagcagttattgagaagctccgntcgtacgtttcggacggtagggacccgtgggaggagactacgacgacgaacgtgtcggntcgacaccagtctacgttctacg

SEQ ID NO: 408611 - DNA, 556 bp, Homo sapiens
  misc_feature: GZ8MTXP02FMCJO.11.11.A11.1.454.CMB.2.raw
  modified_base (366)..(366): a, c, t, g, unknown or other
  modified_base (371)..(371): a, c, t, g, unknown or other
  modified_base (446)..(446): a, c, t, g, unknown or other
  modified_base (501)..(501): a, c, t, g, unknown or other
  modified_base (539)..(539): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagagggccaccatcgagtgcaagtccagcgagacttcttttatatagtgtcaacgataaggactatttagcttggtatcagacaaaaaccaggaacagacctacctaaaactgcctcatcctcctgggcatcctaccccgggcaccccggatccccgtgaccgattcaggtggcacggcgggtcgtgggacagtacttcnctccncaaccatcagccaacctgcgaggctagaagatggtaggctaagtttattactgtacagtctaagttatgtagaanccttacgctacgtacgtttacggggcgggtacggggcccggcgggtacggagtanaccgtaggaaccgtaacgtggtacggctggccaccgtnttacctcgttccttacc

SEQ ID NO: 408612 - DNA, 587 bp, Homo sapiens
  misc_feature: GZ8MTXP02HZWPH.11.11.A11.1.454.CMB.2.raw
  modified_base (276)..(276): a, c, t, g, unknown or other
  modified_base (362)..(362): a, c, t, g, unknown or other
  modified_base (397)..(397): a, c, t, g, unknown or other
  modified_base (464)..(464): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggacttattagcttggtatcagcaaaaaccaggacagcctactaaactgctnactctcctgggtcatcctacccgggcaccccggagtccctgaccgattcagtgcgacgcggggtctaggacagtacttcactcctnacccatacagaccacctgcaggcctgaagagttgnggtactagtttaattactagtaccgtagccgtagttattacgtggaaacgtccgttaccgcgttacnccggttttaccggggacggaccgggggttaaccgccggggtaggtacggaaacgttcgaacggaacgaacgtcgggtacggtcgtcggtaccaacccgtacttcgttaccggtttccttaccg

SEQ ID NO: 408613 - DNA, 689 bp, Homo sapiens
  misc_feature: GZ8MTXP02IKB1H.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaacgataaggacttattagcttggtatcagacaaaaaccaggaacacgcctacctaaactcgctcatcctccgtgggcatcccgtaccccgggccaccccgggacgtccccgtagacccgtactttcaggtggcgacggtcgggtcgtggggacacgtaccttcacctctaccaccatccacgtaccaacctcgacgacggtactaggaaagtagttcggtacggtactttaaggtttttacttaacgttgttaccgaggtacttaaggttagtttaggttaggtaaacgttccccttccggtaccttccgttaccggtttaccgggggaccggggtaacgggggtaccccggtacgggggttagggaaccggtaacgtaccggtaaacgggaccgtaaaaccggttgggtacgggtccgtacggtaaccctacccgtaccgtttccgtttacggtttcccttttaacccg

SEQ ID NO: 408614 - DNA, 786 bp, Homo sapiens
  misc_feature: GZ8MTXP02G1EIO.11.11.A11.1.454.CMB.2.raw
  modified_base (210)..(210): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccacatcgagtgcaagtccagcgagtacttcttttanatagtgtacaacgataaggacttattagcttgtatcagacaaaacaggacagcctacctaaactgcctacactcctccgtggggacctacgtaccccggtacccccggggcctaacccccggggtacgttcccccgtacggaacccgtactttaccgacggtcgggaccacgggtccggggtcgtacggggaacctacggtacctttcaccttcctaccaaccacgttccgaacggtaccctaaaacccgttgggaacccacggggtacccttaaagggaaaacgtacggttaggggttacccgggtagttttaaacgtttttaacgtttaacgttacgggtttaacccaaacgggtacgttaaggttttaagtttacgggtttaaacgggaaaaccgttcccgttaccccgtaccgtttacccggttaaaccgggttttccgggggaccgggggttaacggggaccccggggttacgggttacgggaaggttaccgtacggaaacggtaaccggtaaacgttcgggtacggcttacggacccgtaaacgtccttacgttcggtttcctttacccg

SEQ ID NO: 408615 - DNA, 659 bp, Homo sapiens
  misc_feature: GZ8MTXP02FHZOR.11.11.A11.1.454.CMB.2.raw
  modified_base (282)..(282): a, c, t, g, unknown or other
  modified_base (437)..(437): a, c, t, g, unknown or other
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagaccttcttttaatatagtgtacaacgataaggactatttagcttggatcagacaaaaccaggacagccctactaaactgctanatctccgtgggcacgtccgtaccccggggacaccccggacgtccccgtggacccgtattccgagtcggacacggcgggtacgagggactacgtacttcaccgtccaccacctagtccaacgaccctaaacgtcgacgaggtccaaggtaaacggngttcgagggtacttaaggtttatacgtgtacagtactaggttacttaggtagaactcccgtcgtaccgttacgttaaccggtttcccggggaacggggttacggggaccccgggttaaggggtcggggtaaactacggtaaacccgaaggtaaaacccggtttacggtgggtaccggtccgtaacgacctaacccgtatttaccgtccgtttacccgtaacc

SEQ ID NO: 408616 - DNA, 610 bp, Homo sapiens
  misc_feature: GZ8MTXP02FFZXW.11.11.A11.1.454.CMB.2.raw
  modified_base (398)..(398): a, c, t, g, unknown or other
  modified_base (413)..(413): a, c, t, g, unknown or other
  modified_base (426)..(426): a, c, t, g, unknown or other
  modified_base (436)..(436): a, c, t, g, unknown or other
  modified_base (446)..(446): a, c, t, g, unknown or other
  modified_base (479)..(479): a, c, t, g, unknown or other
  modified_base (580)..(580): a, c, t, g, unknown or other
tcagcgagagataccacgaccggtgctcgatttagctacgactgcaggggcagcaagatggtgttgcagacccaggtcttcatttctctgttgctctggatctctggtgcctgtgggacatcctgatcgacccagtccccagatatcctgcctgtgtctcgtgggcgaggacgggccaaccatcggagtgacaacgtccagcgagtacttcttttaatatagtgtacaaacgagtaaaggtacttagtttagcgtttaggtatacgaagaacaaaaaccgaggtacaacgtccctaaccctaaactcgacctactacgtcctccgtgggacacgttcccgtaccccggaccaccccggacgtcccagaccgtattccgagtcgacgacggtcggtcgngggacacgtccttcncctcctacactancagcctaacngacgacggtnaagagtagttcgaggactttaatttctacgttnaccgagtactagttagtcggtaacgcctcccgttaccgcgtttcctacggttcggaccggggaagggcccgtggaccggagctacgaacgtaccgtacggngcgaacgtcgacctactctcgtactctacg

SEQ ID NO: 408617 - DNA, 808 bp, Homo sapiens
  misc_feature: GZ8MTXP02F8NJE.11.11.A11.1.454.CMB.2.raw
tcagcgagagataccacgaccggtgctcgatttagctacgactgcaggggcagcaagatggtgttgcagacccaggtcttcatttctctgttgctctggatctctggtgcctggtggggacatcctgatcgacccacgtccccagatactcctgcctgtcgtctcgtgggcgaggacgggcccaccatcggagtgacaacgtccacgcgagtactttctttatatagtgtacaaacgtaagtaagtacttatttagtcttaggtaatacgaacgaaaccaaaaaccgaggaaccacgtacccctaacctaaactcgtactactactacctccggtcggtaccacctccccggtacccgggaccccgaccccgggtaccgttcccccgtacggaccgttacgttacggtacgggtacggccgtaaccggggtccggggtcggtacggggtaacctaccggttaaccccttaccgtaccttaccctaccctaacccgtacctaccgaccgtaacccgaaacccgtcggtacgaccggtaccgtaagtaaacggttacgtagggttacggttactttaaaggttttacttacgtgttacgacgtattagttacgttggtaacggtcctaccgtccgttacgtacggtttaccgggtcggaaccgggggtacggggtaccggtacggggttacgggacgttaaacggtaacggaaaacgggtacccggtaacgggttcggtaacgggtcccgtaaacggggtaacccctaaacgggtttacctcgtttaaccggtttccctttaaaccccgg

SEQ ID NO: 408618 - DNA, 521 bp, Homo sapiens
  misc_feature: GZ8MTXP01DGUWC.10.55.E11.1.454.CMB.2.raw
  modified_base (201)..(201): a, c, t, g, unknown or other
  modified_base (362)..(362): a, c, t, g, unknown or other
  modified_base (395)..(395): a, c, t, g, unknown or other
  modified_base (493)..(493): a, c, t, g, unknown or other
  modified_base (507)..(507): a, c, t, g, unknown or other
  modified_base (509)..(509): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcagggccagtgtaaccttttagagttagttatttagcctggtatcggacaaaactggccaggctccccgatcctcttcttggtgagcctacagggccactggccaccccagacaggatcagtggcagcgggtctgggacagacttnattctcaaccatcaaacagactgcagctagaanatattgctagtttacactgtcagcagtatgttacgcccggtgacgttcgacgaaggacaagtggacaatcaacgaactgaagcttgcacatcttgttnttcaatcttccccncnttctgaactaac

SEQ ID NO: 408619 - DNA, 541 bp, Homo sapiens
  misc_feature: GZ8MTXP01CFEM0.10.55.E11.1.454.CMB.2.raw
  modified_base (201)..(201): a, c, t, g, unknown or other
  modified_base (370)..(370): a, c, t, g, unknown or other
  modified_base (492)..(492): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcagggccagtgtaaccttttagtagtagttatttagcctggtatcggacaaaactggccaggctccccgactcctcttctttggtggagcctacagggccactggcaccccagacaggatcagtggcagcgggtctgggacacgacttcattcncaaccatcaaacagactgcagcctagaagatatgctagtttactactgtcagcagtatgttaccgtcccggtggacgttcggaccgaagggacccaagggtcgacaataccaaccgaactgnggcttggcaccatcttgttcttcaatccttcccgccattctgaactaac

SEQ ID NO: 408620 - DNA, 511 bp, Homo sapiens
  misc_feature: GZ8MTXP01DGJ2V.10.55.E11.1.454.CMB.2.raw
  modified_base (447)..(447): a, c, t, g, unknown or other
  modified_base (472)..(472): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtcggatacaggtcaccgcgtctatattaatggctgcgacaggcccctggacaagggcctgagtggagtggggagaatcaacccgagtggaggtggtgcgaaggagtcgcccaggaggtttcgagggcagagtctccatgaccagtgacacgtcgcgagcactgtctagtagtggagatgaggagctgagtacttgacganaacggcgttatattacgtgtgacgngaactggaaagaaggtggacttactaagttcgtaacggg

SEQ ID NO: 408621 - DNA, 573 bp, Homo sapiens
  misc_feature: GZ8MTXP01AV5PR.10.55.E11.1.454.CMB.2.raw
  modified_base (201)..(201): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctccgtgggggganacgccaccctctcctgcagggccagtgtaaccttttagtagtagttattagcctggtatcggacaaaaacctggccaggctccccgactcctcttcttggtggagcctacagggccactggcaccccagacaggatcagtggcagcgggtctggggacacggacttcattcctcaaccatcaaacagactgcagcctagaacgatattgactagtttactactgtacagccagtactgtttaaccgtcccgggttgggtaccggttccggaccgaaaggggacccaagggtgacgaagtccaacgaacctggtaaggcttggcaccatcttacgttcttcaattcccttcccgcctacttctcgaactaacc

SEQ ID NO: 408622 - DNA, 579 bp, Homo sapiens
  misc_feature: GZ8MTXP01CL8KU.10.55.E11.1.454.CMB.2.raw
  modified_base (324)..(324): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtccgtggggcctgagtgaagatttcctgcaaggcgtccggatacaggtcacgccgtctatattaatggctgcgacacggcccctggacaagggcctgagtggagtgggganaatcaaccgagtggaggtggtgcgaagagtcgcccagaggttcagggcagagtctcatgaccagtgacgacgtcgcgagcactgtactagtagtgggagagtgaaggacgccgtaggaacgtacttcggaaccggaaccgaaccgggtacccgttaagttaacgtttacgtaggttcggacggaaggttaaaacgttaacgggaaaaggtaacggggttagggaccttaaacgtaaacgttcccggtaaacgggg

SEQ ID NO: 408623 - DNA, 548 bp, Homo sapiens
  misc_feature: GZ8MTXP01EC6IY.10.55.E11.1.454.CMB.2.raw
  modified_base (201)..(201): a, c, t, g, unknown or other
  modified_base (533)..(533): a, c, t, g, unknown or other
  modified_base (536)..(536): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctccgtgggggganacgccaccctctcctgcagggccagtgtaaccttttagtagtagttattagcctggtatcggacaaaacctggccaggctccccgactcctcttcttggtggacgcctacgagggccacgtcggccaccccagacaggatcgagtggcaggcgggtctgggacacgacttcattctcaaaccatcaaacagactgacagcctagaagtattatgactagtttactatgtcagcagtatacgttaccgtcccgggtggtaccgttcggaccgaagggaccaaggtgacaatacgaacgatggaagcttgcacatcttgttcttcaatcctccnctnttctgaactaac

SEQ ID NO: 408624 - DNA, 537 bp, Homo sapiens
  misc_feature: GZ8MTXP01C0W76.10.55.E11.1.454.CMB.2.raw
  modified_base (201)..(201): a, c, t, g, unknown or other
  modified_base (211)..(211): a, c, t, g, unknown or other
  modified_base (527)..(527): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctntcctgcagggccagtgaaccttttagagttagttattagcctggtatcgggacaaaaacctggccaggctccccgactcctcttcttggtggagcctacagggccactggccaccccagaccaggatcagtggcagcgggtctgggacagacttcattcctcaacccatcaaacagactgcagcctgaagatattgctagtttacatgtcagcagtatgttacgtccccgggtggtaccgttcggaccgaagggaccaaggtgacaatcaacgaactggtgcttgcaccgtatcttgttcttcaatccttcccgcnttctgctaac

SEQ ID NO: 408625 - DNA, 512 bp, Homo sapiens
  misc_feature: GZ8MTXP01D588N.10.55.E11.1.454.CMB.2.raw
  modified_base (431)..(431): a, c, t, g, unknown or other
  modified_base (469)..(469): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggtcaccgcgtctatattaatgctgcgacaggcccctggacaagggcctgagtggagtggggagaatcgaacccgagtgggaggtggtgcaaggagtcgcccagtacggtttcaggggcaggagtcgccatgacagtgacacgtcgcgagcactgtctagtatggagatgaggngccgtagagtacttgacgacaacggcgttatattacgngtgcgagataagtaagaaggtggacttactaagttcgaacggg

SEQ ID NO: 408626 - DNA, 610 bp, Homo sapiens
  misc_feature: GZ8MTXP01D1PYY.10.55.E11.1.454.CMB.2.raw
  modified_base (200)..(200): a, c, t, g, unknown or other
  modified_base (353)..(353): a, c, t, g, unknown or other
  modified_base (560)..(560): a, c, t, g, unknown or other
  modified_base (595)..(595): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgctccgtgggggganacgccaccctctcctgcagggccagtgtaaccttttagtagttagttatttagccttggtatcggacaaaactggccaggctccccgatcctcttcttggtgagcctacgagggccactcggcaccccagacaggatcgagtggcaggcggtntgggacagacttcattctcaaccatcaaacagactgacacgcctagaagtatatgactagtttactaactgtacagctaagtacttagttacccggttcccggggtagggtaccggtttccgggaccggtaaacggggtacccgaaaggggttcgggaacctaaacgttaccgaaacccgtaaacgtgggtaacggtcttcggaccncctaagtcttacgttcttacaacttcctcccaccnttactcgaacttaac

SEQ ID NO: 408627 - DNA, 564 bp, Homo sapiens
  misc_feature: GZ8MTXP01B51KD.10.55.E11.1.454.CMB.2.raw
  modified_base (200)..(200): a, c, t, g, unknown or other
  modified_base (350)..(350): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgctccgtgggggganagccaccctctcctgcagggccagtgaaccttttagtagtagttattagcctggtatcggacaaaaacctggccaggctccccgactcctcttctttggtggagcctacagggccactggccaccccagacaggatcagtgcagcgggtntgggacagacttcattctcaaccatcaaacagactgacagcctagaagataattgctagtttactactgtacagcagtatcgttaaccgtcccggtggtacgttcggaccgtaaagggacccaagggtcgacaatccgaaaccgaactggtaacggcttgccacctatcttacgttcttcaattcccttcccgcctattccttaagaacctaac

SEQ ID NO: 408628 - DNA, 534 bp, Homo sapiens
  misc_feature: GZ8MTXP01BAZET.10.55.E11.1.454.CMB.2.raw
  modified_base (201)..(201): a, c, t, g, unknown or other
  modified_base (211)..(211): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctntcctgcagggccagtgaaccttttagagttagttattagctggtatcggacaaaactgccaggctcccgactcctcttctttggtggagcctacagggccactggcaccccagacaggatcagtggcagcggtctgggacagacttcattctcaaccatcaaacagactgcagcctagaagatatgctagtttactactgtcagcagtatcgttacgtcccggtaggacgttcggaccgaaggtaccgaaggtggacaatacaaccgaactgaaggcttgcacgatcttcgttcttcaatccttccgcacttctgaacctaac

SEQ ID NO: 408629 - DNA, 572 bp, Homo sapiens
  misc_feature: GZ8MTXP01EDTFH.10.55.E11.1.454.CMB.2.raw
  modified_base (213)..(213): a, c, t, g, unknown or other
  modified_base (241)..(241): a, c, t, g, unknown or other
  modified_base (323)..(323): a, c, t, g, unknown or other
  modified_base (335)..(335): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagngtccgtggggcctgagtgaagtattccngcgaaggcgtccggatacgagtcacgcgtctatattatgctgcgacgacggcccctggacaagggcctgagtggagtggganaactcgaaccgnggtggaggtggtgcgaagacgtcgccaaggtaggtttcagggcagacgtctcagtgaccaggtgaacgtacggtccgacgacgctacgttgtctaagtagtgggaagtataggaggacgccgtaggtacgtacggttacgaacccggacgaaccgggtccgttaagtacgtttacgtggtagacggagttaacgtaacggaaaggaagggtcggtacttactaacgttcgtaacggg

SEQ ID NO: 408630 - DNA, 584 bp, Homo sapiens
  misc_feature: GZ8MTXP01EUCO4.10.55.E11.1.454.CMB.2.raw
  modified_base (213)..(213): a, c, t, g, unknown or other
  modified_base (226)..(226): a, c, t, g, unknown or other
  modified_base (240)..(240): a, c, t, g, unknown or other
  modified_base (321)..(321): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagngtccgtgggcctnagtgaagtattccngcaggcgtcggatacagtcacgcgtctatatatgctgcgacgacggcccctggacgaagggcctggagtggagtggggganaatccgaaccggaggtgggaggtggtgacgaagacgtccgcccgaagggtacggttcgaggggtcaggtacgtctaccgagtcgaccgtaggtcgaccgaccgtccggacgacgctacgtgtactaggtagtgggaagtagtaggacggacgccgtaggacgtacgtggaaccgacgaacggtaccgttattacgttacgtggtacgacgagttaacgtaacggaaaggtaagggttggacttaacgtaacgttcgtaacggg

SEQ ID NO: 408631 - DNA, 641 bp, Homo sapiens
  misc_feature: GZ8MTXP01CXIRI.10.55.E11.1.454.CMB.2.raw
  modified_base (237)..(237): a, c, t, g, unknown or other
  modified_base (244)..(244): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggaggtcttctgcttgctggctgtagttccaggtgctcactcccaggtgcagctggtgcagtcgtggggctgagagtagaagagtccgtggggcctgagtgaagtntttccgngacgaaggcggtccggatacgaggtccaccgccgtactatattaattggctgcgacgacggccccgtaggacgaagggcctggacggttggaggtagggggaagaacgtccgaaccggaggtcgggagggtggtgacgaaggacgtcgcccgtaagggtacggttacgacggggacaggtacgtctaccgtagtacggaaccgaggtacggaaccgacccggtaccgcgtaacggctacgtcgtactaagttgtaggggataggtacggaaggacgcgtaggacgtacgtacgacgaccgaacggtaccgttaattagttaccgttgtcggaccgaagggttaacgttaacgggaaagtaacgggtcgtaacgttaacgtaacgttcggtaaacggg

SEQ ID NO: 408632 - DNA, 597 bp, Homo sapiens
  misc_feature: GZ8MTXP01EDF0E.10.55.E11.1.454.CMB.2.raw
  modified_base (199)..(199): a, c, t, g, unknown or other
  modified_base (447)..(447): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctcgtggggganacgccaccctctcctgcgagggccagtgtaaccttttagtagttagttattagctggtatcggacaaaactggccaggctcccgactcctcttctttggtgacgcctacgacgggccaactcgggaccaccccagaacgaggactcgagtggcgaggtccgggtcgtggggaacacggacttcattctcaaaccatcaaacagactcgacagcctagaagtatagttgactagtttactactgttacngtactagtattcgttacccggtcccggttagggaccgttcggaccgaagggaccgaggtggacaataccgaacctacgtgtcgcttcgacacgtactacttcgttccttctaacttccgttccctactacttccgtaacgaaccttaacc

SEQ ID NO: 408633 - DNA, 524 bp, Homo sapiens
  misc_feature: GZ8MTXP01D8J3N.10.55.E11.1.454.CMB.2.raw
  modified_base (234)..(234): a, c, t, g, unknown or other
  modified_base (240)..(240): a, c, t, g, unknown or other
  modified_base (285)..(285): a, c, t, g, unknown or other
  modified_base (331)..(331): a, c, t, g, unknown or other
tcagcatagtagtgcacgaccggtgctcgatttagcactcgcacgttgggtttgggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagagtccgtgggcctgagtgaagtntttccngcaaggcgtcggatacaggtcacgcgtctatatatggctgcgacnggcccctggacaagggcctgagtggagtggggagaagtcgaaccgngtggaggtggtgcgaagagtcgcccgagtagggtttcagggcagagtctcatcgacgagtgacacgtcgcgagcactgtactagtagtggagagtgagcgctagacgtagttcgacgtcgaacggtcgttatacttacgtgtagcgagaagtaacggaaagtaagggtggacttaacgtaagttcgtaacggg

SEQ ID NO: 408634 - DNA, 577 bp, Homo sapiens
  misc_feature: GZ8MTXP01C2249.10.55.E11.1.454.CMB.2.raw
  modified_base (272)..(272): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggaggtcttctgcttgctggctgtagttccaggtgctcactcccgaggtgcagctggtgcagtcgtggggctgagatgaagagtccgtggggcctgagtgaagtatttcctgcgaaggcgtcggatacgaggtcaccgctntatattatgctgcgacgacggcccctggacgaagggcctggaggtggagtaggggaagaactccgaaccggaggtgggaggtggtagacgaagacgtccgacccgagggtacgggttcgagggcagacgtctacagtacgacgaggtacgaccgacgtccgcgagcacgttgtactaagtagtagggaagtagtaggaaggcgtccgtaggacgtaacgttcggaaccgaacgaacggtaccgttattacgttacgtggtacgagagagtaacggaagaaggtgacttaacaacgttcgtaacgg

SEQ ID NO: 408635 - DNA, 555 bp, Homo sapiens
  misc_feature: GZ8MTXP01EVG71.10.55.E11.1.454.CMB.2.raw
  modified_base (227)..(227): a, c, t, g, unknown or other
  modified_base (260)..(260): a, c, t, g, unknown or other
  modified_base (271)..(271): a, c, t, g, unknown or other
  modified_base (288)..(288): a, c, t, g, unknown or other
  modified_base (318)..(318): a, c, t, g, unknown or other
  modified_base (329)..(329): a, c, t, g, unknown or other
  modified_base (398)..(398): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagagtccgtggggcctnagtgaagtattcctgcgaaggcgtcggatacgnggtcacgcgtntatatatggctgcgacncgccctggacaaggctgagtggagtggganaatcgaaccgngtggagtggtgcgaagacgtccgccgaggtacggttcgaggtcgagacgtctcagtcgaccagtcgacncgtcgcgacgcactgtactagtagtggagagtggacggacgccgtaggacgtacgtagaccgaacgtaacgggtaccttagtacgtttacgtaggtacgacgaaggacgtaacggaaaggtaagggttacggacttaacgaacgttcggtaaacggg

SEQ ID NO: 408636 - DNA, 666 bp, Homo sapiens
  misc_feature: GZ8MTXP01CTF9N.10.55.E11.1.454.CMB.2.raw
  modified_base (213)..(213): a, c, t, g, unknown or other
  modified_base (226)..(226): a, c, t, g, unknown or other
  modified_base (240)..(240): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagngtccgtgggcctnagtgaagtattcgnggcgtaggtcttcgtacggttaacctaccttaacactatggctatcgtccgtgggtcgccgacgacggccccgtaggaactaagggtacgttggagggttgggggtgggggtggtacgacgtcgtcgttaaccccgaggttacggactaacaataaaattatcgactaacgaaggtaacgttaccgaagggactaagtacgtacaacgatacgaaccaacgaacgaaccacactaccacgacgacaacgacggtaccctaagacgacggtaacgtaggacggacgaccgtagagtactaccgtcggaaccggtaacgaccgggtaccgttagttacgtttcggacggttcggacgggaaggtaaacggtaacggttaaaacgggtcgggttaacgggttaacggggttaacggggtaacccggggg

SEQ ID NO: 408637 - DNA, 552 bp, Homo sapiens
  misc_feature: GZ8MTXP01D5ZHM.10.55.E11.1.454.CMB.2.raw
  modified_base (229)..(229): a, c, t, g, unknown or other
  modified_base (243)..(243): a, c, t, g, unknown or other
  modified_base (326)..(326): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcgagtcgtggggctggagatgaagagtccgtggggcctnagtgaagtattccngcaaggcgtcggatacaggtcaccgcgtctatattaattggctgcgacacggcccctggacaagggcctgagtggagtggganaatcgaacccgagtgggaggtggtgacgaagacgtaacgcccgaggtagggtttcgagggtcgagacgtctcgagtcgaccgagtagaccgacgtccgcgagcatgtctagtagtggagtagtggaggacgccgtagagtacgttgaccgacgaacggtccgttaatagttacgtgtgacgagaagtaacgaaaggtaaggtggacttaataacgttcgtaacggg

SEQ ID NO: 408638 - DNA, 701 bp, Homo sapiens
  misc_feature: GZ8MTXP01C94T3.10.55.E11.1.454.CMB.2.raw
  modified_base (218)..(218): a, c, t, g, unknown or other
  modified_base (234)..(234): a, c, t, g, unknown or other
  modified_base (240)..(240): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtccgnggggcctgagtgaagntttccngcgaggcgtcggatacagtcacgcgtctatattaatggctgcgacgacggcccctaggaccgaagggcctaggacggttagggaggttagggggaacgtaacgtaccgaaacccggtacggtaggggaggggtggtacggacgtaaagggaaccggttaacccggaccccgtaaggggtaacggggttttaccggaacgggggtaccgaagggtaacgttcccgttaccgaacgttacggaacccgtaaggttacggaaacccgaccgggttacccggacggaacgaccgtaacgttacggttaccttaaaggtacggttaaggggaagtacggtaggaaggacgccgttaggaacgtacgttacgaccggaacgtaaccggtacgttaagtacttacgttgcgacgttagaagtaacggaaaggtaacgggtcggacttaactaacgttaacgtaacggg

SEQ ID NO: 408639 - DNA, 652 bp, Homo sapiens
  misc_feature: GZ8MTXP01D98O6.10.55.E11.1.454.CMB.2.raw
  modified_base (244)..(244): a, c, t, g, unknown or other
  modified_base (340)..(340): a, c, t, g, unknown or other
  modified_base (634)..(634): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggaggtcttctgcttgctggctgtagttccaggtgctcactcccaggtgcagctggtgcagtcgtggggctgagatgaagtagtccgtggggcctgagtagaagtatttccgngacgaaggccgtacgatacgaggtccacgcgttctaattattaagtgctgcgacgcggccctggacgaagggtcctaggaggtggagtaggggaanaacgtaccgaaaccggtaggtcggggaagggtggtaggaccgaaaagggtaaccggtaaccggaccccggtaaagggttacgggtttaccgggaacggggtacgaagggtaaccggttccctacccgtaagtaccggaaccgagggttacgaacccgtaccgggtccgacggacgcaacgttcgttactaaggttagtggggaatagaggagacgtcgtaggacgtacgtacgaccgacgtaacggtcttatacgttacgtgtagacgagttacgtaaggaagtaaggccgtanacgtaacgttggtaacgg

SEQ ID NO: 408640 - DNA, 650 bp, Homo sapiens
  misc_feature: GZ8MTXP01EGY9F.10.55.E11.1.454.CMB.2.raw
  modified_base (200)..(200): a, c, t, g, unknown or other
  modified_base (211)..(211): a, c, t, g, unknown or other
  modified_base (301)..(301): a, c, t, g, unknown or other
  modified_base (316)..(316): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccacctgtctttgtctccgtgggggganacgccaccctntcctgcagggccagtgtaaccttttagtagttagttattagcctggtatcggacaaaacctggccaggctcccgactcctcttcgttggngagcctacgaggccnctggccaccccagacaggactcgagtggcgaggcgggtcgtaggggacacggtacttcactttcctacaaaccatcaaactagactgcagccttagaagtattattgacttaagtttactaacttgtacagacgtagtattacgttaccgtccccggggttaggtaccggtttccggaccggaaagggacccgtaagggtcgtaaccgaaagttacccgaaaccggtaacgttggtaacgggccttacggaccttaacgtacttcggttacgtttacccttcttaaccgttcccgtttccccgacctaacgttcctaacggttaaccttaaccg

SEQ ID NO: 408641 - DNA, 650 bp, Homo sapiens
  misc_feature: GZ8MTXP01C4XVZ.10.55.E11.1.454.CMB.2.raw
  modified_base (238)..(238): a, c, t, g, unknown or other
  modified_base (245)..(245): a, c, t, g, unknown or other
  modified_base (336)..(336): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccgaggtgcagctggtgcagtcgtggggctgagatgaagagtccgtggggcctgagtagaagtntttccgngacgaaggcgtccggatacgaggtcaccgtccgtctatattaatggctgcgacacggcccgtggacgaaggccgtgagtggagtagggganaaacgtcgaaacccggaggtacggggaagggtggtacgacgaaagggtaacggtaacccggaccccgtaagggtaacggggttttacccgaagggggtacaacgggtacggttccttaccgagttacgaccgtaaggtacgaccgaacggtcccggacgaggaccacgtagtaccgttaagtagtgggtaagagtaggaggagcccgttaggacgtacgttacgacgacgaaccggtccttagttaccgttagtggtacgacgttagaagtaacgaaggtaacggtcgacgttacgtaacgttcgtaaacgggg

SEQ ID NO: 408642 - DNA, 681 bp, Homo sapiens
  misc_feature: GZ8MTXP01CZUA7.10.55.E11.1.454.CMB.2.raw
  modified_base (235)..(235): a, c, t, g, unknown or other
  modified_base (242)..(242): a, c, t, g, unknown or other
  modified_base (336)..(336): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggaggtcttctgcttgctggctgtagttccaggtgctcactcccaggtgcagctggtgcagtcgtggggctgagatgaagcgtccgtggggcctgagtgaagtntttccgngacgaaggccgtccggatacgacggtcaccgcgtactataattagtgctgacacgacggcccctggacgaaggcctggagtggagtaggggaanaacgtaccgaaccggtaggtggggaaggtgggtacgacgaaacggtaacgtaacccggacccgaaagggttacgggtttaccgaagggggtaccgaagggtacgttaccgttaccgaacgtacggaacccgtaggttaccggaacccgtaccggtcccggacggacggaccaaccgttgttaccgttaaggtaacggttaggggaagttagtagggaacggacgtccgtaaggtacgtacgttacggaaccgaccggaacggtaaccgttagttaaccttacgttggacgaggttaacgaagtaacggaaaggtaaggtacggtaccaagtaacgcgttaacggg

SEQ ID NO: 408643 - DNA, 728 bp, Homo sapiens
  misc_feature: GZ8MTXP01A1DHO.10.55.E11.1.454.CMB.2.raw
  modified_base (199)..(199): a, c, t, g, unknown or other
  modified_base (296)..(296): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctccagagacgaccggagagattgtattgacgcagtctccaaccacctgtctttgtctccgtgggggganacgccaccctctcctgcgagggccagtgtaaccttttagtagttagttattagctggtatcggacaaaactggcagctcccgactcctcttcttggngagcctacgacgggccacgtcggccaccccgagacaggactcgaggtggcgaggtccggggtcgtcggggactaccggtacctttactacgtttcctaccaaaccctaactaaccgaaacaacgggtacctacggaccgtaacggtcccgtaaaggaaacggttaattaacggtttcgactttaacggtttaactacgttgtaccagtacttacgttacgttcggtttaacccggtcccgggggttacggtaaccgggttccgggaaccgggtaaacggggtaacccgtaaggggttacggaaccgtaaacgtacccggaaaacccggttaacgtcgggtcgggtaccttacgggaccttaccgtattcccgttacggttccttacctcgttaccctttccccgacttcttaccttaacgaacctttaaccg

SEQ ID NO: 408644 - DNA, 752 bp, Homo sapiens
  misc_feature: GZ8MTXP01EBMNK.10.55.E11.1.454.CMB.2.raw
  modified_base (199)..(199): a, c, t, g, unknown or other
  modified_base (298)..(298): a, c, t, g, unknown or other
  modified_base (349)..(349): a, c, t, g, unknown or other
  modified_base (366)..(366): a, c, t, g, unknown or other
tcagcatagtagtgcacgaccggtgctcgatttagcactcgcacgttgggtttggggagctgctcagttaggacccagagggaaccatggaaagcccagcgcagcttctcttcctcctgctactctggctcccagagacgaccggagagattgtattgacgcagtctccaaccacctgtctttgtctccgtgggggganacgccaccctctcctgcgagggccagtgtaaccttttagtagttagttattagcctggtatcggacaaaactggccaggctcccgactcctctcttggnggacgcctacgaggtccactcggcaccccagacagatcagtgcaggcggtntggacacgcttcattcncaaccatcgaaacagtactgactacggccttaggaagtattaacgttcgacgttaaacggtttactaaccgtaggttacccaaggtaccgttaacggttaacgttacgggtttaaaccccgggttccccggggggttaacggggttaacccggggtttaccgggaaaccccgggttaaacggggtaaacccccgaaagggggttacgggaaaccctaaacgtaccccggttaaaaccccggtaaagtttcgggaaacggttccgaccgggtaccgttaccccgtaaagttccctttaacggttccctttacctaaccgggtttccccttcccccgggttacccgtaactttacccggttaaccggttaaacccgttttaaaccccg

SEQ ID NO: 408645 - DNA, 780 bp, Homo sapiens
  misc_feature: GZ8MTXP01B245D.10.55.E11.1.454.CMB.2.raw
  modified_base (618)..(618): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcacctcccaggtgcagcgtggtgctaggtcgtgggggctggagtagtaggaaggtacggttcccggtgggggcccttcgaagggttagtaaacgttattttcccgtaggaccgaagggcccggttaccggaataccgtacgggtcccacccggtcccgttacttaattaagtttaaagttcggcttacggccggaaccgaccggtcccccggtagggaaccggtaacgggggtccccgttagggaacgggttagggggtacggttaggggggaacgtaaacggtacccggaaaccccggtaggggtagggggtaaggggttcgggtacggacggaaacgtaacgggttaaccccggacccgtaacgggtacggggtttacggaggggtacgagggtacgtcctacgagtacgacctaggtacgacccgaccggtccgacggacgtaccncgttagtaccttaggtgtggtaagagtggaggcgcgtaggtacgtacgttacgaccgacgtaacgggtccttaagtacgtttacgtggtcggaacggttagttaacggtaacggtaagggtaacgggttcggaacttacgtaacgttaaccggttaaccggg

SEQ ID NO: 408646 - DNA, 534 bp, Homo sapiens
  misc_feature: GZ8MTXP02GM4D4.10.55.E11.1.454.CMB.2.raw
  modified_base (199)..(199): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctcctggggganagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctggggacagacttcattctcaccatcaaacagactgcagcctagaagatattgctagtttactactgtcagcagtatgttacgtcccgtggtacgttcggaccgaagggaccaagggtggacaatccaaaccgaactggtacggctgcaccgatctcgtcttcaatcttcccgcatctcgactac

SEQ ID NO: 408647 - DNA, 505 bp, Homo sapiens
  misc_feature: GZ8MTXP02FX5UT.10.55.E11.1.454.CMB.2.raw
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggagtggggagaatcaaccgagtggaggtggtgcagagtcgccagaggtttcagggcagagtctccatgaccagtgacacgtcgcgagcactgtctatatggagagtgaggagctgagacttagacgacgacggccgtagtacttactgtgacgagaatcggaagaacggtggactaacgaatacgaacgg

SEQ ID NO: 408648 - DNA, 567 bp, Homo sapiens
  misc_feature: GZ8MTXP02IEU3U.10.55.E11.1.454.CMB.2.raw
  modified_base (332)..(332): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaggcctgagtggatggggagaatcaaccgngtggaggtggtgcgaggagtcgcccagagggtttcaggggcagagtcctcatgaccagtgacacgtccgcgacgcactgtctatagtggagagtagaggagcctggacgtacgttcgaaccgacgaacggtaccgttaattacgtttaaccgtggttacgaccggtaagtaaacgttaaccggaaaaggtaagggtacgggtaccttaaaccgaaagtttaccggtaaaccgggg

SEQ ID NO: 408649 - DNA, 552 bp, Homo sapiens
  misc_feature: GZ8MTXP02GEIKK.10.55.E11.1.454.CMB.2.raw
  modified_base (201)..(201): a, c, t, g, unknown or other
  modified_base (354)..(354): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctccgtgggggganacgccaccctctcctgcagggccagtgaaccttttagtagtagttattagcctggtatcggacaaaactggccaggctccccgactcctcttctttggtggagcctacagggcccacgtggccaccccagacaggatcagtggcaggcgggtntgggacagacttcattctcaccatccaaacagactgcagcctagaaagtattatgctagtttactactgtacagcagtatgttaccgtcccgtggtacgttcggacgaagggaccgaaggtcggacaatcaaaccgtatggtcggactgacaccatcttacgtcttacaacttcccttccgacctatctacgactaac

SEQ ID NO: 408650 - DNA, 514 bp, Homo sapiens
  misc_feature: GZ8MTXP02JSL8Q.10.55.E11.1.454.CMB.2.raw
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagtatttcctgcaaggcgtccggatacaggttcaccgccgtctatattaattggctgcgacaggcccctggacaagggcctgagtggagtggggagaatcgaaccgagtggaggtggtgcgagagtcgcccaggaggttcgagggcagagtctccatgaccagtcgacacggtccgcgagcactgtctatatggagagtagaggagctgagacttgacgacacggacgtatactacgtgtcgcgagaagtcggaagaaggtacggactacgaacgtcgtaacgg

SEQ ID NO: 408651 - DNA, 539 bp, Homo sapiens
  misc_feature: GZ8MTXP02F7X5A.10.55.E11.1.454.CMB.2.raw
  modified_base (199)..(199): a, c, t, g, unknown or other
  modified_base (507)..(507): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccacctgtctttgtctccgtggggganagccaccctctcctgcagggccagtgtaaccttttagtagtagttatttagccttggtatcggacaaaacctggccaggctccccgactcctcttctttggtggagcctacgaggccactggccaccccagacaggatcagtggcaggcgggtctggggacacgacttcattctcaccatcaaacagactgcagcctagaagattatgactagtttacactgcagcagtatgttaccgtcccgtggtaccgttcgaccgaaggaccaggtcgacaatacgaacgatggtacggctggccaccatcgtntcttcaacttcctcccgctactctacgactac

SEQ ID NO: 408652 - DNA, 529 bp, Homo sapiens
  misc_feature: GZ8MTXP02HLEQC.10.55.E11.1.454.CMB.2.raw
  modified_base (200)..(200): a, c, t, g, unknown or other
  modified_base (259)..(259): a, c, t, g, unknown or other
  modified_base (271)..(271): a, c, t, g, unknown or other
  modified_base (287)..(287): a, c, t, g, unknown or other
  modified_base (289)..(289): a, c, t, g, unknown or other
  modified_base (294)..(294): a, c, t, g, unknown or other
  modified_base (381)..(381): a, c, t, g, unknown or other
  modified_base (458)..(458): a, c, t, g, unknown or other
  modified_base (480)..(480): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctccgtggggganagccacctctcctgcagggccagtgaaccttttagagtagttattagctggtatcgganaaaactgcagcncccgactctctcttgngncctanaggcactggcacccagacaggatcagtgcagcggtctgggacacgacttcattctacaccatcaaacagaactgacagcctagaaantattgctattactatgtcagctagtatagtaccgtcccgtggtacgttcggacgaaaggaccaaaggtcggactaanaccaaacgactaggtcgacgtnacactactcgtacttctactaacttcctacccactactctacgtaacac

SEQ ID NO: 408653 - DNA, 505 bp, Homo sapiens
  misc_feature: GZ8MTXP02JQVX5.10.55.E11.1.454.CMB.2.raw
  modified_base (225)..(225): a, c, t, g, unknown or other
  modified_base (239)..(239): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctnagtgaagatttccngcaaggcgtccggatacaggttcaccgccgtctatattaattggctgcgacaggcccctggacaagggcctgagtggatggggagaatcaccgagtggaggtgtgcagagtcgccagaggtttcagggcagagtctccatgaccagtgacacgtccgcgagcactgtctatatggagagtgaggagcctggacgacgttagacgacgacggccgtatacttactgtcgacgagaatcgaagaaggtgacgtacaacgtcgtaacgg

SEQ ID NO: 408654 - DNA, 544 bp, Homo sapiens
  misc_feature: GZ8MTXP02IIWUA.10.55.E11.1.454.CMB.2.raw
  modified_base (201)..(201): a, c, t, g, unknown or other
  modified_base (372)..(372): a, c, t, g, unknown or other
  modified_base (401)..(401): a, c, t, g, unknown or other
  modified_base (520)..(520): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctccgtgggggganacgccaccctctcctgcagggccagtgtaaccttttagtagtagttatttagccttggtatcggacaaaacctggccaggctcccgactcctcttctttggtgagcctacagggccactggccaccccagacaggatcagtggcaggcggtctggggacagacttcattcncaccatccaacagactgcagctagaagtntattgctagtttactatgtacagctagtataggttaccgtcccgtggtacgttcgacgtaagggaccaaggtgacaacgtcaacgtatggtacggctgacacgactactcgttcttacncttcctcccgctatctacgactac

SEQ ID NO: 408655 - DNA, 692 bp, Homo sapiens
  misc_feature: GZ8MTXP02F0HJP.10.55.E11.1.454.CMB.2.raw
  modified_base (201)..(201): a, c, t, g, unknown or other
  modified_base (358)..(358): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctccgtgggggganacgccaccctctcctgcagggccagtgtaaccttttagagtagttatttagccttggtatcggacaaaacctggccaggctccccgactcctcttctttggtggacgcctacagggccactggccaccccagaccaggatcaggtggcaggcgggtntggggacaggacttcattctcaccatcaaacagactgacagcctagaaagattagttgactaagtttactacgttgtaccgagtacgtagttacgttacgggtttaacccggtcccccggttaggggtaaccggtttcccggggaacccggaaaacgggggtaacccccgtaaagggggttaccgggaccgtaaaacgttacccgaaaacccggtaaacggttcggttaacggccgttacgggacccgtaaccctaagtttccgttacggttcctttaccgaaccgtttcccttccccggtacccctaatttcccggtaacgtaaccgttaacc

SEQ ID NO: 408656 - DNA, 571 bp, Homo sapiens
  misc_feature: GZ8MTXP02G7QMS.10.55.E11.1.454.CMB.2.raw
  modified_base (201)..(201): a, c, t, g, unknown or other
  modified_base (374)..(374): a, c, t, g, unknown or other
  modified_base (384)..(384): a, c, t, g, unknown or other
  modified_base (388)..(388): a, c, t, g, unknown or other
tcagcatagtagtgcacgaccggtgctcgatttagcactcgcacgttgggtttgggggagctgctcagttaggacccagagggaaccatggaaagcccagcgcagcttctattcctcctgctactctggctcccagagacgaccggagagattgtattgacgcagtctccaaccaccctgtctttgtctccgtgggggganagccaccctctcctgcagggccagtgtaaccttttagtagtagttatttagcctggtatcggacaaaaccgtggccaggctccccgactcctcttcgtttggtggacgcctacgacgggccactggccaccccgagacaggatcagtgcaggcggtctgggacagactcatcncacatcaacnactncagcctagaatatatgctaagtttactactgtacaaacgtgttactcgttaccgtccccggtaggtaccggttcgaccggaagggaccgaagggtcgactaagtacgaaccgtacgtgtcgctacggcacgtactctcgtcctcgtactccgtcccgacgtactcgtacgacctacgttaacg

SEQ ID NO: 408657 - DNA, 566 bp, Homo sapiens
  misc_feature: GZ8MTXP02GY1U6.10.55.E11.1.454.CMB.2.raw
  modified_base (201)..(201): a, c, t, g, unknown or other
  modified_base (553)..(553): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctccgtgggggganacgccaccctctcctgcagggccagtgaaccttttagtagtagttatttagcctggtatcggacaaaactggccaggctccccgactcctcttctttggtggacgcctacacggggcccacgtcgggccacccccgagaacgaggactccaaggtcggcaggcggggtctggggacacgacttcattctcaccatcaaacagactgacacgcctagaaagtataactgactaagtttactactgtcagctagtacttagttaccgtccgtaggtccgttcggacgtaaacgggcaaaggtggacaagtcaaccgatcggtagctgacacactctcgtactcaatcttacccnctactcactactc

SEQ ID NO: 408658 - DNA, 595 bp, Homo sapiens
  misc_feature: GZ8MTXP02JFHAF.10.55.E11.1.454.CMB.2.raw
  modified_base (200)..(200): a, c, t, g, unknown or other
  modified_base (391)..(391): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctcctgggggganagccacctctcctgcagggccagtgaaccttttagagtagttatttagcctggtatcggcaaaacctggccaggctccccgactcctcttctttggtggagcctacagggccactggcaccccagacaggatcagtggcaggcggtctgggacagacttcattctcaccatcaacagactgcagcctgaanatatgacagtttactactgtcagcagtatgttacgtcccgtggtacgttcggaccgtaaagggaccgtaaggtcggacaaacgttccgaaaccggtaacgtggttacggccgttacggacccaaccctaacttccgttacggttccctttacgaacgtttccctttaccccggaccctaactttcccttacgaccttaaacccg

SEQ ID NO: 408659 - DNA, 646 bp, Homo sapiens
  misc_feature: GZ8MTXP02JODRU.10.55.E11.1.454.CMB.2.raw
  modified_base (198)..(198): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctccagagacgaccggagagattgtattgacgcagtctccaaccacctgtctttgtctccgtggggganacgccaccctctcctgcagggccagttcgtaaccttttagagttagttatttacgcctggtatcggacaaaaccgtggccaggcctccccgacttcctcttctttggtgacgcctacgacgggccactgggccaccccgagaccgaggactcgagtggcaggcgggtcaggggacaggtacttcgatttcacaaccatccaaacaacgtacgtcgaccgaacgccgttaaggaaacgtattaaagttcgacctttaagttttaaccctacgttacggttacaagtactagtagtttacgttacccggtacccggtaggtaccgggttacgacccggaaagggtaccgaaggtacggaacaacgtaccgaaacccgtaagtcggtacggctaggaccaacctagttccttcgtacttcaacttccttacccgctactcgtacaactaac

SEQ ID NO: 408660 - DNA, 570 bp, Homo sapiens
  misc_feature: GZ8MTXP02I394Z.10.55.E11.1.454.CMB.2.raw
  modified_base (201)..(201): a, c, t, g, unknown or other
  modified_base (299)..(299): a, c, t, g, unknown or other
  modified_base (302)..(302): a, c, t, g, unknown or other
  modified_base (346)..(346): a, c, t, g, unknown or other
  modified_base (416)..(416): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctccgtgggggganagccacctctcctgcagggccagtgtaaccttttagagttagttatttagcctggtatcggacaaaacctggccaggctcccgactcctcttcttggnganctacaggccactggccacccagacaggatcagtggcagcgggtntggggacagacttcattctcaccatcaaacagactgcagcctagaaagtatattcgactagtttactatntacagtcagtactcggttaaccgtcccgtaggtacgttccggaccgtaaggggaaccaagggtcggacaaatacgaaaccgtaacgtggtacggcttagaccaacacgtctcgtccttacaacttcccttacccgctactcctagactaaaccg

SEQ ID NO: 408661 - DNA, 618 bp, Homo sapiens
  misc_feature: GZ8MTXP02GZNQC.10.55.E11.1.454.CMB.2.raw
  modified_base (242)..(242): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagagtccgtggggcctcagtgaagtatttccngcgaaggcgtccggatacaggttcaccgcgtctatattatggctgcgacgcggcccctggacgaagggcctggagtggagtggggagaacgtaccgaaccggaggtgggaggtggtgacgaggacggtccggcccgaagggtacgggtttacgaggggcgaaggtacggttcctccgaagtcgaacccgtagtcgaacgaccggtccgacgacgcacgttgtactagtagtaggagagtaggaggacgcgtaggacgtaccgttagaccgaacggtaccggaccgttaattacgttacgtaggtacgaaccggaagtaaacgtaacgggaaaggtaacggggtacggtaacctaaacgaacgttacggtaaacggg

SEQ ID NO: 408662 - DNA, 572 bp, Homo sapiens
  misc_feature: GZ8MTXP02HL2NT.10.55.E11.1.454.CMB.2.raw
  modified_base (201)..(201): a, c, t, g, unknown or other
  modified_base (301)..(301): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcagggccagtgaaccttttagagtagttatttagcctggtatcggacaaaacctggccaggcctccccgactcctcttctttggngagcctacaggccactggccaccccagacaggatcagtggcaggcgggtctggggacagacttcattcctcaccatcaaactagactgcagcctgaaacgatattgctagtttacactgtcagctagtattggttaccgtcccggtggtacgttcggaccgtaagggaccaagggtcgacaagtaccgaaaccgtaactggtacggctaggacctactacgtctcgttaccttctaacttccgtacccacctattaccctacgtacctaac

SEQ ID NO: 408663 - DNA, 575 bp, Homo sapiens
  misc_feature: GZ8MTXP02IG4TQ.10.55.E11.1.454.CMB.2.raw
  modified_base (226)..(226): a, c, t, g, unknown or other
  modified_base (323)..(323): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtccgtggggcctnagtgaagtatttcctgcaaggcgtccggatacaggttcaccgccgtctatattatgctgcgacacggcccctggacaggcctgagtggagtgggganactcgaaccggagtggaggtggtgacgaggacgtccggcccgtaggtacggtttcgaggggtacaggtacgtcctccgagtacgaccgtagtagaccgtaccggtacccgcgacgaccacttggtacttagtagttagggagtagtaggacggcgtaccgtggacgtacgttaggaccgaacgaccggtaccgtattacttacgtgtcgacgagaagtcggaaagaggtacggactaccgagtacgtaacgg

SEQ ID NO: 408664 - DNA, 751 bp, Homo sapiens
  misc_feature: GZ8MTXP02IYQJU.10.55.E11.1.454.CMB.2.raw
  modified_base (200)..(200): a, c, t, g, unknown or other
  modified_base (301)..(301): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctccgtggggganacgcccaccctctcctgcagggccagtgtaaccttttagtagtagtttattagcctggtatcggacaaaactggcaggcctcccgactcctcttctttggngacgcctacgagggccacgtcggccaaccccgagaccgaggactcgagtggcgaggcgggtcgtggggacacggtaccttcgacttctacgaccataccaaacagtacctcgaccacgaccttaaggaaagtacgttattacgtacttaaagttttaacctaacgttggtaccaaggtcctaaaggttaacgttaccggtttacccggttcccccgggttagggtaacccgggtttacccgggaacccggtaaaacggggtaaacccgtaacggggttacggaaccgtaaacgtaccccgtaaaaccggtaccgttacggttacgggacccgtacggtaaccctaaacccgttacttacccgttaccggtttcctttaccctaaacctttcccccgtttacccccgtacccgttaaccttacccgtttaaccggtaacctttaaaacccg

SEQ ID NO: 408665 - DNA, 501 bp, Homo sapiens
  misc_feature: GZ8MTXP02JSZYB.10.55.E11.1.454.CMB.2.raw
  modified_base (322)..(322): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaatggctgcgacaggcccctggacaaggcctgagtggatgggganaatcaaccgagtggagtggtgcagagtcgcccagaggttcagggcagagtctccatgaccagtgacacgtccgcgagcactgtctatatggagatgaggagcctgagacttgacgacacggccgtatacttacgtgtgacgagaagtcgaaagaacggtggactacgaagtacgaacgg

SEQ ID NO: 408666 - DNA, 515 bp, Homo sapiens
  misc_feature: GZ8MTXP02FZHF8.10.55.E11.1.454.CMB.2.raw
  modified_base (225)..(225): a, c, t, g, unknown or other
  modified_base (382)..(382): a, c, t, g, unknown or other
  modified_base (396)..(396): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctnagtgagattcctgcaaggcgtccggatacaggttcaccgccgtctatattaattggctgcgacacggcccctggacaagggcctgagtggagtggggagaatcaacccgagtggaggtggtgcgagagtcgcccagaggtttcgagggtcagagtcncatgaccagtgacncgtcgcgagcacgtgtctatagtggagagtgaggagccgtgacgacttagacgaacgacggccgtagtacttacgtgtcgacgagaatcgaaagaaggtcggactacgactacgaacgg

SEQ ID NO: 408667 - DNA, 622 bp, Homo sapiens
  misc_feature: GZ8MTXP02HDA6Z.10.55.E11.1.454.CMB.2.raw
  modified_base (201)..(201): a, c, t, g, unknown or other
  modified_base (447)..(447): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtcctccaaccaccctgtctttgctccgtgggggganagccaccctctcctgcagggccagtgtaaccttttagtagttagttattagcctggtatcggacaaaacctggccaggcctccccgactcctcttctttgggtgacgcctagacgggcccacgtggaccaccccaggaaccaggactcgagtggcgaggcgggtcgtggggacacgtacttcattcctacaccatcaacagactgcagctagaaagtatattgactagtttacatgcagctagttntacggttaccgtcccggtaggtaccgttcgggaccgaaacgggtaccgaaggttacggactaagtaccgaaaccgtaacgtcggttacggacgttcggacctaacctacgttcctacggttcctttacgtaacgttcccgtttaccccgacttacgttcctaacggacttaaccg

SEQ ID NO: 408668 - DNA, 574 bp, Homo sapiens
  misc_feature: GZ8MTXP02I36XD.10.55.E11.1.454.CMB.2.raw
  modified_base (201)..(201): a, c, t, g, unknown or other
  modified_base (299)..(299): a, c, t, g, unknown or other
  modified_base (304)..(304): a, c, t, g, unknown or other
tcagcatagtagtgcacgaccggtgctcgatttagcactcgcacgttgggtttgggggagctgctcagttaggacccagagggaaccatggaaagcccagcgcagcttctattcctcctgctactctggctcccagagacgaccggagagattgtattgacgcagtctccaaccaccctgtctttgtctccgtgggggganagccaccctctcctgcagggccagtgtaaccttttagtagtagttattagcctggtatcggacaaaactggcaggctcccgactcctctcttggtgancctanaggccatgcacccagacaggatcagtgacaggcggtctgggacagacttcattctcaaccatcaaacagactgacacgcctagaaagattagttgactaagttttaacactcgtaactaaacgagttatcgttaacccgtcccggtagtaccggttcggaccgaaacggggaccaaacgggtggacctaaagtacaaaacccgtagtcgaggtcagaccacctatctcgtcttacacttcccgttccacctagtcctacaactacttaac

SEQ ID NO: 408669 - DNA, 712 bp, Homo sapiens
  misc_feature: GZ8MTXP02J1MWZ.10.55.E11.1.454.CMB.2.raw
  modified_base (238)..(238): a, c, t, g, unknown or other
  modified_base (245)..(245): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtgggggctgagatggaagcgtccgtggggcctgagtgaagtntttccgngacgaaggcgtccggatacgacggttccaccgcgtactatattaagtggctgacgacgacggccccgtaggacgaagggcctaggaggtgggaggtaggggaacaacgtaccgaaccggaggtggggtagggtgggtagacgaaggacggtaccggacccgtaagggtacgggttacggacggggactaacgggtacggttccctacccgtaaacggttaccggaaaccggtacggtaccggacccggtacccggggtacccggaccgggtaacgtacctaacgttacgttacgttaagtaggtagggaagtaggtagggaacggacggtaccgtaggaacgtacgttacggaaaccggacgtaccgggtacgttaacgttaacgtacgttaggacggaaccggtaaggaaaacgtaacgggaaaaggtaacgggtacggtaactacgtaaacgtcggtaaacgggg

SEQ ID NO: 408670 - DNA, 628 bp, Homo sapiens
  misc_feature: GZ8MTXP02FP29H.10.55.E11.1.454.CMB.2.raw
  modified_base (227)..(227): a, c, t, g, unknown or other
  modified_base (242)..(242): a, c, t, g, unknown or other
  modified_base (272)..(272): a, c, t, g, unknown or other
  modified_base (319)..(319): a, c, t, g, unknown or other
  modified_base (333)..(333): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagagtccgtggggcctnagtgaagtatttccngcaaggcgtcggatacaggtcaccgccgtntatattatgctgcgacacggccctggacaggctgagtggagtggganatcgaccgagtggnggtggtgcgagagtccgccaggtaggttcgagggtcagacgtctccgagtacgaccgtagtcgaccaccggtccgacgacgaccgacgttacgttacttaagtaaggttaggggtaagaacggttagggaaacgggtacggttacccgttagggaaacggtacgtttacgggaaccgggaaccggtaaccgggtacccgttaaagtttaacgttaaccggttggttacgggacgtaaggtaaacgtaaggaaaaggtaagggttacggacttaaacgacgtaccggttaaacggg

SEQ ID NO: 408671 - DNA, 616 bp, Homo sapiens
  misc_feature: GZ8MTXP02F6QW8.10.55.E11.1.454.CMB.2.raw
  modified_base (213)..(213): a, c, t, g, unknown or other
  modified_base (227)..(227): a, c, t, g, unknown or other
  modified_base (240)..(240): a, c, t, g, unknown or other
  modified_base (270)..(270): a, c, t, g, unknown or other
  modified_base (279)..(279): a, c, t, g, unknown or other
  modified_base (285)..(285): a, c, t, g, unknown or other
  modified_base (314)..(314): a, c, t, g, unknown or other
  modified_base (334)..(334): a, c, t, g, unknown or other
  modified_base (387)..(387): a, c, t, g, unknown or other
  modified_base (399)..(399): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagngtccgtggggcctnagtgaagtattcngcaaggcgtcggatacgagtcaccgccgtntatatatgntgcacncggccctggacaggctgagtgagtggganaatcgaaccgagtggagtgngcagacgtcgccaggtagttcgagggcagacgtctcgagtcgaccagtcgacncgtaccgcgacncgacttacgtactaagtagtgggaagtagtaggaacggacggtaccgttcgggaacgtaccggttacgggaaccggaaccggtaacccggggtacccgttaaagtttaaccgttacggttacggttacggtaacggaaacggtaaaacggtaaccggggaaaaaggttaacggggtacgggtaacctaaacggtaaacgtacccggttaaaacgggg

SEQ ID NO: 408672 - DNA, 578 bp, Homo sapiens
  misc_feature: GZ8MTXP02FZQHI.10.55.E11.1.454.CMB.2.raw
  modified_base (201)..(201): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcagggccagtgaaccttttagtagtagttatttagcctggtatcggacaaaacctggccaggctccccgactcctcttctttggtggagcctacgagggccacgtcggccaccccagacaggatcagtggcaggcgggtctgggacagacttcattctcaccatcaaacagactgcagcctagaagatatgactagtttactactgtcagtctagtatcgttaccgtcccgtggtacgttcggaccgtaaagggaccgaaggtcggactaaacgtccgaaaccgtaacgtgtacggtactagaccaacctatccgtcgttccttacaacttccgttccccgcctaactccgtacgacctaac

SEQ ID NO: 408673 - DNA, 611 bp, Homo sapiens
  misc_feature: GZ8MTXP02F3QXI.10.55.E11.1.454.CMB.2.raw
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtatgacgcagtctccaaccaccctgtctttgtctccgtggggggagacgccaccctctcctgcaggccagtgtaacctttagtagtagttattagcctggtatcggacaaaaccgtggccaggcctccccgactccttcttcgttggtggacgcctacgacgggccacgtcggccaccccgagacaggactcgagtcggcaggcgggtctgggacacgtacttcattcctacacctatccgaaacaggtaacctgaccaacgcctagaaagtattagttgacttaagtttactactgttacagtctaagttagttcgttaaccggtcccgtagggtacgttccggacgtaaagggacccaagggtcggaacaagtaccgaaaccgtaacgtggtcgcgtcgaacctacgatccgtcgtccttactaacttccctcccgtactactcgtacaccttac

SEQ ID NO: 408674 - DNA, 661 bp, Homo sapiens
  misc_feature: GZ8MTXP02HJNTA.10.55.E11.1.454.CMB.2.raw
  modified_base (228)..(228): a, c, t, g, unknown or other
  modified_base (237)..(237): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagagtccgtggggccctnagtgaagtnttccgtgcgaaggcgtaccggatacgtacggttccacccgtccgtactaatattaagtcggctgcgacgacggccccgtaggaacgacgggcctaggaggttggagtaggggaactaagtacccgaaaccggaggtagggaagggtgggtaggacgtaacgggacgttacccgggccccgtaaggttacggggtttaccgaaggggtaccgaaggtacgtaccgtacgacgtcgaaccgagtacgacccgacgtccggacgtacgcacgttcgtactagtaggttagggagtagtaggacggacgtccgtagaacgtcgtagacgaacggtaccggtacgttaagttacttacgtaggtacgacggtaagaaagtaacgggaaaagggaaggtcggtaaccaactaaacgttaccgggtaacgg

SEQ ID NO: 408675 - DNA, 561 bp, Homo sapiens
  misc_feature: GZ8MTXP02FVC95.10.55.E11.1.454.CMB.2.raw
  modified_base (242)..(242): a, c, t, g, unknown or other
  modified_base (326)..(326): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagagtccgtggggcctgagtgaagtatttccngcaaggcgtccggatacaggttcaccgcgtctatattaatggctgcgacaggcccctggacaagggcctgagtggagtgggganaatcaaccgagtggaggtggtgcagagtcgccagaggttcaggggcagagtcgccagtgaccagtgacacgtccgcgagcactgtactatagtggagagtggaacggagaccgttggaacgtacgttacggacgaaccgtacggaccgttaattaacgttaacctcggttagaccggaagtaaagtaaccggaaaggtaagggtacggtacctaaacgtaaacgtcgtaaacggg

SEQ ID NO: 408676 - DNA, 564 bp, Homo sapiens
  misc_feature: GZ8MTXP02FF8FD.10.55.E11.1.454.CMB.2.raw
  modified_base (201)..(201): a, c, t, g, unknown or other
  modified_base (400)..(400): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcagggccagtgaaccttttagagtagttatttagcctggtatcggacaaaacctggccaggctccccgactcctcttcttggtggagcctacgaggccactggccaccccagacaggatcagtggcaggcgggtctggggacagtacttcatttctcaccatcaaacagactgcagcctagaanatattgctagtttacactgtcagcagtattacgttaccgtcccgtggacgttcggaccgaagggacccaagggtggacaagtaccaaaccgtatggtacggtctgaccacctattccgttacgtccttacaacttccttaccccgcctactcctacgactaacc

SEQ ID NO: 408677 - DNA, 560 bp, Homo sapiens
  misc_feature: GZ8MTXP02HT87X.10.55.E11.1.454.CMB.2.raw
  modified_base (235)..(235): a, c, t, g, unknown or other
  modified_base (241)..(241): a, c, t, g, unknown or other
  modified_base (294)..(294): a, c, t, g, unknown or other
  modified_base (350)..(350): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtccgtggggcctcagtgaagtntttccngcgaaggcgtccggatacgaggttcaccgccgtctatattaatggctgcgacnggcccctggacaaggcctgagtggagtgggagaactcaaccgagtggaggtggtgnaggagtccgccaggacgtttcgagggcagacgtctcatgtaaccagtgacgccgtcgcgagctacgtgtactagtagtaggagagtaggaggacgccttaggacgtacgttacgacgacgtacggtacccggttaattaacttaaccgttgacgtacgaagaaacgttaacggaaggtaagggttacgacgtaacaacgttacgaacggg

SEQ ID NO: 408678 - DNA, 626 bp, Homo sapiens
  misc_feature: GZ8MTXP02JHFDN.10.55.E11.1.454.CMB.2.raw
  modified_base (201)..(201): a, c, t, g, unknown or other
  modified_base (368)..(368): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcagggccagtgaaccttttagagtagttatttagcctggtatcggacaaaacctggccaggcctccccgactcctcttctttggtggacgcctacacggggccacgtcggccaccccagaccaggactcagtggcagcgggtcgtggggacnggacttcacttctacaccatcaaacagactgcacgcctagaaagtattattgactagtttaactacgtgtcacgtacgtagttacgttacgttaccggttccccggtagggtaaccgtttccgggaccgtaaacggggtacccgaaaggggttcggaacgaacttaccgaaaaccggacgtggtacgggacttagggaccacctaacgtcctgttaccttcgaacttccgtttacccctcctactccgtactactacg

SEQ ID NO: 408679 - DNA, 709 bp, Homo sapiens
  misc_feature: GZ8MTXP02J1H31.10.55.E11.1.454.CMB.2.raw
  modified_base (201)..(201): a, c, t, g, unknown or other
  modified_base (303)..(303): a, c, t, g, unknown or other
  modified_base (305)..(305): a, c, t, g, unknown or other
  modified_base (339)..(339): a, c, t, g, unknown or other
  modified_base (357)..(357): a, c, t, g, unknown or other
tcagcatagtagtgcacgaccggtgctcgatttagcactcgcacgttggggtttgggggagctgctcagttaggacccagagggaaccatggaaagcccagcgcagcttctcttcctcctgctactctggctcccagagacgaccggagagattgtattgacgcagtctccaaccaccctgtctttgtctccgtggggganagccacccgtctcctgcagggccagtgtaaccttttagagttagttatttagcttggtatcggacaaaacctggccaggcctcccgactcctcttctttggngngcctacgaggccacgtggccaccccgagacaggntcgaggtgcaggcggtcngggacacgtacttcattcctcaaccatccgaaacacggtactgaccacgtcccgtaagaaacgtattacttaggaaccttaaggttttaaccctacgtcggttacctaaggtctaacgtttacgttaccggtttaacccgggttcccccggtaagggtacccggtttacgggacccgggaaaaggggtaccccgaaaggggttcggaaccgttaaacgtaacccgtaaacccggtaaacgttggttaccgggccgttacggacccgtaaaccgttcttaccgttaacggttccctttaccgaacgtttccccttaccccggctttaacccgtcgttaccgaacctttaaccg

SEQ ID NO: 408680 - DNA, 579 bp, Homo sapiens
  misc_feature: GZ8MTXP02JTROY.10.55.E11.1.454.CMB.2.raw
  modified_base (181)..(181): a, c, t, g, unknown or other
  modified_base (240)..(240): a, c, t, g, unknown or other
  modified_base (296)..(296): a, c, t, g, unknown or other
  modified_base (334)..(334): a, c, t, g, unknown or other
  modified_base (350)..(350): a, c, t, g, unknown or other
  modified_base (364)..(364): a, c, t, g, unknown or other
  modified_base (527)..(527): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtncagctggtgcagtcgtggggctgagatgaagagtccgtgggcctgagtgaagtcttccnggacgaaggcgtaccggatacgagttcaccgtcgtactattattagtgctgcgacncggcccgtggaacgacggctggaggtggagaggggaanaacgtaccgaaccggnggtgggaggtcggnggacaggacgtccgacccgaggtacggttgaggcgagtacgtactcagtacgacgagtcgacgaccgtccgcgacgacgatacgtcgtaattgaggtagacggtagacggtacgtccgtaagtacgtacgttacgaacgaccggtacgtaccgtattacgtanggacgacgaagagtaacggaaggacggcgtaacgacgtacgtacggtaacgg

SEQ ID NO: 408681 - DNA, 671 bp, Homo sapiens
  misc_feature: GZ8MTXP02HFWH2.10.55.E11.1.454.CMB.2.raw
  modified_base (201)..(201): a, c, t, g, unknown or other
  modified_base (309)..(309): a, c, t, g, unknown or other
  modified_base (314)..(314): a, c, t, g, unknown or other
  modified_base (410)..(410): a, c, t, g, unknown or other
  modified_base (432)..(432): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcagggccaggtcgtaaccttttagtagttagtttatttagccttggtatcggacaaaaccgtggccaggcctcccgactcctcttcgtttggnggacncctacgacgggccacgtcggccaccccgagaccaggactcgaggtggcacggcgggtcgtaggggacacggtacttcattctcaaccatccaaacngactgaccagacctagaaagtnttattgacttagtttacagttcgtcagtacgtagtagttaccgggtttaacccgttcccggtaggttaacccggtttaccgggaccggtaaacgggggtaaaccctaggggtacggacgtaaaacgttaccgaaaccggtaatcgggttacgcgttacgaccctaacttaacgttccgttacgttacctttactaacccttcccgttcccgtacctacttccttacggaaccttaaccg

SEQ ID NO: 408682 - DNA, 703 bp, Homo sapiens
  misc_feature: GZ8MTXP02GIKYD.10.55.E11.1.454.CMB.2.raw
  modified_base (202)..(202): a, c, t, g, unknown or other
tcagcatagtagtgcacgaccggtgctcgatttagcactcgcacgttggggtttgggggagctgctcagttaggacccagagggaaccatggaaagcccagcgcagcttctcttcctcctgctactctggctcccagagacgaccggagagattgtattgacgcagtctccaaccaccctgtctttgtctccgtgggggganacgccaccctctcctgcagggccagtgtaaccttttagtagttagttatttagccttggtatacgaacaaaaacctggccaggcctccccgactcctcttcgtttggtggacgcctacgagggccacgtcgggccaccccagaccaggatcgagtcggcgacggccggggtcgtagggacacggtacctttcacttccgtacaacctactccaaacagacctgaccaacgtcctagaaagtattagtcgtacttaacggttttaactacgtgtacaaggtactaaggttacgttacggtttaaccccggttccccgggttaggggtaccggtttacccgggacccgggaaacggggtaacccgtaaaggggttaccggacttaaaaccgaaccggtaaacccggtaacgttacgggtcggtacgttaccgaccgtaacctacgtttcgtacgttccctttacgaaccgtttacccttcccgacctactctacgaactaccg

SEQ ID NO: 408683 - DNA, 583 bp, Homo sapiens
  misc_feature: GZ8MTXP02HV3RK.10.55.E11.1.454.CMB.2.raw
  modified_base (200)..(200): a, c, t, g, unknown or other
  modified_base (299)..(299): a, c, t, g, unknown or other
  modified_base (355)..(355): a, c, t, g, unknown or other
  modified_base (377)..(377): a, c, t, g, unknown or other
tcagcatagtagtgcacgaccggtgctcgatttagcactcgcacgttgggtttgggggagctgctcagttaggacccagagggaaccatggaaagcccagcgcagcttctattcctcctgctactctggctcccagagacgaccggagagattgtattgacgcagtctccaaccaccctgtctttgtctccgtggggganagccaccctctcctgcagggccagtgaaccttttagtagtagttatttagcctggtatcggacaaaacctggccaggctcccgactcctcttctttggngagcctacgaggccactggcaccccagacaggatcagtggcagcgggtctgggacngacttcattctcacatcaacanactgcagcctagaagtatagttgactagtttaactactgtacaactagtatgttaccgtcccggtggtaacggtttcgaccgaagggaccgaggtcggacaaagtaccaaaccggtatacggtcggtactcggtaccaacctagtcctttacgtcctttacgtacttcccgttccccgactaacgttcctacgtactacctttaac

SEQ ID NO: 408684 - DNA, 708 bp, Homo sapiens
  misc_feature: GZ8MTXP02GX0LS.10.55.E11.1.454.CMB.2.raw
  modified_base (199)..(199): a, c, t, g, unknown or other
  modified_base (309)..(309): a, c, t, g, unknown or other
  modified_base (680)..(680): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccacctgtctttgtctccgtgggggancgcccacctctcctgcgagggccagtcgtaacttttagtagttagttattagctggtactcggacaaaacgtggaccaggcctccccgactcctcttcgtttggtggacncctacagggccacgtcggaccaccccgagaccgaggtatacgaggtcggacgacgggtccggggttacgacggggacaaccggtacttacgtaacttcccttaccaaccctactacccaaacgaacggtacctaccgaccgaacggtacccttaggaaacgtatttaacgttacgtactttaacggttttaaccctacgtttacgtacgtaacgtaccgtaagttacgtttaaaccgggttcccggttaccccggggttaggttacccgggttaacccgggaccggtaaacggggacccgtaaaggggtacgaacgtaacgtaccgaaaccgtaacgtggtcgcgtagccacgtactcgtacgtcttaccncttcccttaccgacatcgtacaacttac

SEQ ID NO: 408685 - DNA, 605 bp, Homo sapiens
  misc_feature: GZ8MTXP02FXMNX.10.55.E11.1.454.CMB.2.raw
  modified_base (226)..(226): a, c, t, g, unknown or other
  modified_base (234)..(234): a, c, t, g, unknown or other
  modified_base (240)..(240): a, c, t, g, unknown or other
  modified_base (284)..(284): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagagtccgtgggcctnagtgaagntttccngcaaggcgtcggatacaggttcaccgccgtctatattaattggntgcgacaggcccctggacaagggcctgagtggagtggggagaatcaaccgagtggaggtggtgcagacgtacgcccagaggtttccgagggacagacgtctccatgaccagtgacacgtcgcgagacactaggtactatagtaggagaagttggaaggagacccgtgggaagacgtttacgacggaaaccgaaccggacccgggttaaagtttaaacctttaacgttacgggttcgaacgggtaagtaaaacgtaaacggtaaaagggaaaagggttacgggggaaccctttaaaagaaaacgttacgtaaaacccggggg

SEQ ID NO: 408686 - DNA, 530 bp, Homo sapiens
  misc_feature: GZ8MTXP02GZBKY.10.55.E11.1.454.CMB.2.raw
  modified_base (200)..(200): a, c, t, g, unknown or other
  modified_base (301)..(301): a, c, t, g, unknown or other
  modified_base (388)..(388): a, c, t, g, unknown or other
  modified_base (409)..(409): a, c, t, g, unknown or other
  modified_base (483)..(483): a, c, t, g, unknown or other
  modified_base (506)..(506): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctccgtggggganagccaccctctcctgcagggccagtgaaccttttagtagtagttatttagccttggtatcggacaaaacctggccaggctccccgactcctcttctttggngagcctacagggccactggccaccccagacaggatcagtggcaggcgggtctggggacacggacttcgattctacaccatccaaacngactgcagcctagaagatatnactagtttactactgcagctagtatgttaccgtccgtggacgttcgcgaaggaccaggtcgacaatcaacgacngtagctgcacgactcgtagtctnaactcttcccgctatctacactac

SEQ ID NO: 408687 - DNA, 611 bp, Homo sapiens
  misc_feature: GZ8MTXP02HY8K0.10.55.E11.1.454.CMB.2.raw
  modified_base (234)..(234): a, c, t, g, unknown or other
  modified_base (239)..(239): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggaggtcttctgcttgctggctgtagttccaggtgctcactcccaggtgcagctggtgcagtcgtggggctgagatgaagagtccgtgggcctgagtgaagtnttccngcgaggcgtccggatacgaggtccaccgccgtactatattaagtggctggacgacgcggcccctaggaccaacgggctggaggtggagtggggagtaactccgaaccggaggtgggacggtgggtacgacgaaggacgtaccggcccgaagggttacggttacgaggggcagtacgtccctacagtcgacgtaggcgaccgtaccggtccgacgacgacctacgtcgttactagtagtaggagtagtaggaggacggaccgttaggacgttacgtgaacccggaagtaccggggtacttaagttacgttacgtcggtacgacggtaagaacgtaaggaaaggtacgggtacgactaacgacgttacgtaagg

SEQ ID NO: 408688 - DNA, 632 bp, Homo sapiens
  misc_feature: GZ8MTXP02IPM41.10.55.E11.1.454.CMB.2.raw
  modified_base (212)..(212): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagngtccgtggggcctgagtgaagtatttcctgcaaggcgtccggatacaggttcaccgccgtctatattaattggctgcgacaggccccgtggacgaagggcctggagtggagtggggaagaagtacgaacccgaggtgggagggtggtggcgaagacggtaccggcccgtaagggacggggttttacgacgggggtccagggtacggttcctccgagtcgaaccgtacggtacgaaccgaccggtacccggcgaccggcgacgttcggtacttagtagttagggagtagtaggaagggtacgccgttaggacgtacgttacggacgtaaccgaccgggtacccgtagttacttaaccggtgtacgaccgtaagaacgtaacggaaaggtaggtacgggtactaactaacgtacgtaacggg

SEQ ID NO: 408689 - DNA, 782 bp, Homo sapiens
  misc_feature: GZ8MTXP02HQ9X4.10.55.E11.1.454.CMB.2.raw
  modified_base (199)..(199): a, c, t, g, unknown or other
  modified_base (305)..(305): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccacctgtctttgctccgtgggggganacgccaccctctcctgcagggccagtgtaaccttttagtagtagttattagccttggtactcggacaaaacctggccaggctccccgactcctcttctttggtggngcctacaggccacgtggccacccccagacaggactcaggtcggcaggcggggtacgtgggacacgacgttcacgtttctcgaacccagtccaaacacgaacttcgacctacgacccgttaggaaagtaacttagtttacgaccgttaaggtttttacctaaaccgttggttacctaaggggtaccctaaggtttaacgtttacggggttttaacccccggtttaccccccgggtttacggggtttaaccgggttttccccgggggaacccggttaaaaccgggggaaaccccgtaaaacgggggtttcgggaaacccgtaaacggtacccgtaaacccggtaaaccgttacggggtacggggtaccgttaccgggaacctacccggtaaagttacccgttggttaccccgtttacgtaacctttacccgttcccccggtaccctaaacggttcccttaacgggtacctttaaacccg

SEQ ID NO: 408690 - DNA, 640 bp, Homo sapiens
  misc_feature: GZ8MTXP02HVSFH.10.55.E11.1.454.CMB.2.raw
  modified_base (213)..(213): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagngtccgtggggcctcgagtagaagtattccgtgacgaacggcgtaccggagtacgaggttccaccgtcgtactatattaagttggctgcgacgacggccccgtaggaaccgaggcgtggagtggagtggggaagtagacgaccgtaggacggaggtggtcgagacgacggtaccgtaccgaggtacggttcgacgggtacgagtacgtacgtacagtacgacgagacgacgaccgtcgacgtacgcgtacgtagtctagtaagtagggagtagtagaacggacgtacccgtaaggtacgtacggttacggaaccgtaaccggtaaccgggtaccgtttaaagtttaacttaccggttagtacgggaacgtaagtaaacgtaacgggaaaggtacggtacgtaacgtaacgtaacgtacggtaaacggg

SEQ ID NO: 408691 - DNA, 593 bp, Homo sapiens
  misc_feature: GZ8MTXP02JWSGJ.10.55.E11.1.454.CMB.2.raw
  modified_base (340)..(340): a, c, t, g, unknown or other
  modified_base (390)..(390): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagacgtccgtggggcctcgagtgaagtatttcctagacaaggcgtaccggatacgaggttccaccgccgtactatattaagttggctgcgacgcggcccctggacgaaggctggagtggagtaggggaanaactaccgaaccggagtgggaggtgtagcaggacgtccgccagtaggttngggcagcgtactcgatcgaacctaggcgaccgcgtaccggacggacgtaccgaccttggtacttagtaaggtgacggtagtaggacggcgtaccggagtagacgttagaccgaacgaccggtacgttatacgttacgtgtacgacgtaagtaaggtaacgtaaaagggaggtacggaaccgttaacaacgttacggtaacggg

SEQ ID NO: 408692 - DNA, 623 bp, Homo sapiens
  misc_feature: GZ8MTXP02F8IKX.10.55.E11.1.454.CMB.2.raw
  modified_base (199)..(199): a, c, t, g, unknown or other
tcagcatagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtcttgtctccgtggggganacgccaccctctcctgcagggccagtagtaacttttagtagtattatttagcctggtatcggacaaaactggaccaggcctccccgactcctcttcgtttcggtgacgcctacgacggccactcggaccaccccagacgagactgagtggacgacgcgggtgtgggacacgtacttcattcctacacactacaaacacgactcgcacgctagaaacgattaatcgaacttagtttacatctacacgtactaagttacttacggttacccgtaccggtacgggttacgttaccgggaccggtaaacggggacccgaaaggggttcgaacgaaactccgaaaaccgacgttcggtacggactacggtaccacgtactcgttacgtcttaacgcttacccgttcccactactacgtacacttaaccg

SEQ ID NO: 408693 - DNA, 607 bp, Homo sapiens
  misc_feature: GZ8MTXP02H77HA.10.55.E11.1.454.CMB.2.raw
  modified_base (243)..(243): a, c, t, g, unknown or other
tcagcatagtagtgcacgaccggtgctcgatttagcactcgcacgttgggtttggggagcatcatcccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagagtccgtgggcctgagtgaagtactttccngacgaaggcgtccggatacaggtcaccgccgtactatattagtgctgcgacgcggcccctggacgacggcgtaggaggtggagtaggggaagacgtaccgaaccgaggtacggaggtggtgacgaggacgtaccgcccgaaggtacggtttcgaggggcagacgtctcagtcgacgagcgacgacgtccgcgacgccacgtagtctagtagtggagagtaggacggtagacgtggaacgtacgttacggaaccgaacgtaccgggtacgttaacgttacgttacgttaggtacgaacgaacggtaaacgttaacgggaaaggtaaacggtacggtaaccgtaacgtaacgtacggtaaaccggg

SEQ ID NO: 408694 - DNA, 688 bp, Homo sapiens
  misc_feature: GZ8MTXP02HOOU3.10.55.E11.1.454.CMB.2.raw
  modified_base (205)..(205): a, c, t, g, unknown or other
  modified_base (242)..(242): a, c, t, g, unknown or other
  modified_base (249)..(249): a, c, t, g, unknown or other
tcagcatagtagtgcacgaccggtgctcgatttagcactcgcacgttgggtttggggagcatcatcccaacaaccacatcccttctctacagaagcctctgagaggaaagttcctcaccatggactggacctggaggtcttctgcttgctggctgtagttccaggtgctcactcccgaggtgcagctggtcgcgaggtccggggntggagataggaagcgtccgtggggcctgagtgaagtntttccgngacgaggcgtcggatacgaggttccaccgccgtctatattagtggctgcgacgcggtccccgtaggacgacgggcctggacggtagggtaggtaggggaacgaaacgtaccgaaacccgggtaggtaccggggtagggtggggtacgacggtaacgggtaaccggtacccggcccgggtaagggtacggggtttacgaaggggtaccgaggtacgtccgtacgtacgtcgaccgtagacgaccgacgtccggcgaacgtccgacgttcgtaccttagttagtagggtaagaggtagggaaggtaccggacgtagggtacgtacggtacgaaccggaacggtacccggttacgtagtttacgtaacggtcggtacgtacgaaagtaacggacggtaaagtacgggtacgttacaaacgtacgtacggaacggtttaacgg

SEQ ID NO: 408695 - DNA, 666 bp, Homo sapiens
  misc_feature: GZ8MTXP02GWWBP.10.55.E11.1.454.CMB.2.raw
  modified_base (213)..(213): a, c, t, g, unknown or other
  modified_base (242)..(242): a, c, t, g, unknown or other
  modified_base (333)..(333): a, c, t, g, unknown or other
  modified_base (348)..(348): a, c, t, g, unknown or other
  modified_base (362)..(362): a, c, t, g, unknown or other
tcagcatagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagngtccgtgggcctgagtgaagtctttccgngacgaacggcgtccgatacgcggttcaccgtcgtactatattatgctgcgacgcggcccgtaggacacgggctggagtggaggtagggaanaactaccgaaccggnggtggaggtgtagngacgacgtccgaccgtaggtacggttcgagggacgtaagtacggtacctaccgtaagtacgaaccgtaggtaaccgaacccgacccgggtaccgaccgacgaccgtacgtcggttaacttaagtttaggtaaggacggtaaggtacggaacggggaacgtccggttaagggaaacgttaaccggtacggaaaaccccggacggtaaccggggtacctttagtaaccttaaggtcggtaagtaccggaaagttaacgaaccggtaaaggtaacgggtacgtaactaacgaaacgtcgtaaacggg

SEQ ID NO: 408696 - DNA, 634 bp, Homo sapiens
  misc_feature: GZ8MTXP02GSV1A.10.55.E11.1.454.CMB.2.raw
tcagcatagtagtgcacgaccggtgctcgatttagcactcgcacgttgggtttggggagcatcatccaacaaccacatcccttctctacagaagcctctgagaggaaagttcctcaccatggactggacctggaggtcttctgcttgctggctgtagttccaggtgctcactcccaggtgcagcgtggtgcaggtcgtggggctgagatagaagacggtccgtggggcctcgagtgaagtatttccagcgaaggcgtacggatacgacggttcaccgcgtactattattaagtggctgcgacgacggcccctggacgaaggcctaggaggtggagtaggggaagaacgtacgaaccggaggtcgggagggtggtagcgtaaggacgtccggaccgaggtacggttcgaggggtcaggtacgtctaccgagtcgaaccgtaggtacgacgtaccggtccgacggacgccgtacgttacgtacttaagtaggttaggaaggtagtaccggaaggtacgtaccggttagacggtacgttaaggacgaacgtacgggtaccttaattacgttacgtcggttagacgtaaagtacggtaacggaaggacggttacggacctaagtacgacggttaacgg

SEQ ID NO: 408697 - DNA, 548 bp, Homo sapiens
  misc_feature: GZ8MTXP02GQLEJ.10.55.E11.1.454.CMB.2.raw
  modified_base (114)..(114): a, c, t, g, unknown or other
  modified_base (142)..(142): a, c, t, g, unknown or other
  modified_base (211)..(211): a, c, t, g, unknown or other
  modified_base (216)..(216): a, c, t, g, unknown or other
  modified_base (223)..(223): a, c, t, g, unknown or other
  modified_base (239)..(239): a, c, t, g, unknown or other
  modified_base (320)..(320): a, c, t, g, unknown or other
  modified_base (379)..(379): a, c, t, g, unknown or other
  modified_base (399)..(399): a, c, t, g, unknown or other
  modified_base (440)..(440): a, c, t, g, unknown or other
tcagcatagtagtgcacgaccggtgctcgatttagcactcgcacgttgggtttggggagcatcatccaacaaccacatcccttctctacagaagcctctgagaggaaagttccncaccatggactggacctggaggtcttcngcttgctggctgtagttccaggtgctcactcccaggtgcagctggtgcagtcgtgggctgagatgaagngtcgngggcctnagtgaagtctttccgngcgaaggcgtccggatacagtcaccgcgtctatatatgctgcgcacgccctaggacaaggcctgagtggagtggggaaganacgaaccgaggtggaggtgtagcaggagtccgccaggagttacgaggggacagacgtcncctagtacgacgagtagacncgtaccgacgacgacaacgtcgtactaaagtagtacggaanagtagacggagtacccgtggaacgcgtaggaacgacgacgggtaccttagtactttacgtgtacgacgagaaggtaacgaaaggacggtacgactaacgatcgaacgg

SEQ ID NO: 408698 - DNA, 474 bp, Homo sapiens
  misc_feature: GZ8MTXP01DMU25.4.79.H02.1.454.CMB.2.raw
  modified_base (261)..(261): a, c, t, g, unknown or other
  modified_base (373)..(373): a, c, t, g, unknown or other
  modified_base (467)..(474): a, c, t, g, unknown or other
tcagagcactgtagcacgaccggtgctcgatttagtgtcacacgaagggaaggggctggagtggctttcatacattgatagtagtgggaagatcatatactacgcagactctgtgaagggccgattcaccgtctccagagacaacgccaacaactcactgtttctgcaaatggacagcctgagagccgaggactcggctgtttattactgtgcgagagattccaggagtttgatgctagcgagggcctactatgactacgnggggccagggaaccaaggtcaccgtctcctcagcctccaccaacgggccccatccggtccttcccccgtggccgcccctgcctccgacggacgccacctccgagacgccacncggccggccccgtggggcctcgccctgggtaccaaagggaccttaccttcccctacagtgcctcgtgacggcgggctggcaaggcggcagtagnnnnnnnn

SEQ ID NO: 408699 - DNA, 486 bp, Homo sapiens
  misc_feature: GZ8MTXP01EEEX4.4.79.H02.1.454.CMB.2.raw
  modified_base (252)..(252): a, c, t, g, unknown or other
  modified_base (353)..(353): a, c, t, g, unknown or other
  modified_base (441)..(441): a, c, t, g, unknown or other
  modified_base (469)..(469): a, c, t, g, unknown or other
  modified_base (475)..(486): a, c, t, g, unknown or other
tcagagcactgtagcacgaccggtgctcgatttagtgtcacacgaagggaaggggctggagtggctttcatacattgatagtagtgggaagatcatatactacgcagactctgtgaagggccgattcaccgtctccagagacaacgccaacaactcactgtttctgcaaatggacagcctgagagccgaggactcggctgtttattactgtgcgagagattccaggtagtttgatgctagcgaggctactangactacgcgggcgagggaaccaaggtcaccgtctcctcacgcctccaaccgaacggccccatccggttcctcccccgtggccgccctgcctccgacggccnccaccgtccgacgacgaccacgcggccgcccgtgggctcgccgtgggtaccaacgggtacctacctttcccacgtagtcggtcttcgnggacggcgggctcgggcaacgggccganaagtgnnnnnnnnnnnn

SEQ ID NO: 408700 - DNA, 432 bp, Homo sapiens
  misc_feature: GZ8MTXP02G8Z5U.4.79.H02.1.454.CMB.2.raw
  modified_base (357)..(357): a, c, t, g, unknown or other
  modified_base (427)..(432): a, c, t, g, unknown or other
tcagagcactgtagcacgaccggtgctcgatttagtgtcacacgaagggaaggggctggagtggctttcatacattgatagtagtgggaagatcatatactacgcagactctgtgaagggccgattcaccgtctccagagacaacgccaacaactcactgtttctgcaaatggacagcctgagagccgaggactcggctgtttattactgtgcgagagattccaggagtttgatgctagcgagggcctactatgactactggggccagggaaccaaggtcaccgtctcctcagcctccaccaagggcccatcggtcttccccctggcgccctgctccaggcgcacctcgagagcacngcggccctggggctgcctggtcaaggctaccttcccacagtgctctgagcgggctgggcaggcgcatagnnnnnn

SEQ ID NO: 408701 - DNA, 412 bp, Homo sapiens
  misc_feature: GZ8MTXP02H7X7Q.4.79.H02.1.454.CMB.2.raw
  modified_base (291)..(291): a, c, t, g, unknown or other
  modified_base (325)..(325): a, c, t, g, unknown or other
  modified_base (329)..(329): a, c, t, g, unknown or other
  modified_base (332)..(332): a, c, t, g, unknown or other
  modified_base (337)..(337): a, c, t, g, unknown or other
  modified_base (340)..(340): a, c, t, g, unknown or other
  modified_base (342)..(342): a, c, t, g, unknown or other
  modified_base (346)..(348): a, c, t, g, unknown or other
  modified_base (352)..(352): a, c, t, g, unknown or other
  modified_base (357)..(357): a, c, t, g, unknown or other
  modified_base (361)..(361): a, c, t, g, unknown or other
  modified_base (372)..(372): a, c, t, g, unknown or other
  modified_base (378)..(378): a, c, t, g, unknown or other
  modified_base (380)..(380): a, c, t, g, unknown or other
  modified_base (384)..(384): a, c, t, g, unknown or other
  modified_base (386)..(386): a, c, t, g, unknown or other
  modified_base (392)..(392): a, c, t, g, unknown or other
  modified_base (399)..(399): a, c, t, g, unknown or other
  modified_base (402)..(402): a, c, t, g, unknown or other
  modified_base (404)..(412): a, c, t, g, unknown or other
tcagagcactgtagcacgaccggtgctcgatttagtgtcacacgaagggaaggggctggagtggctttcatacattgatagtagtgggaagatcatatactacgcagactctgtgaagggccgattcaccgtctccagagacaacgccaacaactcactgtttctgcaaatggacagcctgagagccgaggactcggcttgtttatactgtgcgagagattccgaggtagtttgatgctagcgagggcctactatgactacgtggggccagggaaccaaggtccaccgtcncctcacgcctccacacggcccatcgtcctccccngccnccngctcngcncnctcnnncacngcgcnggcncgctgcagtcnctccantnctcngngcggcngcagcgnagngnnnnnnnnn

SEQ ID NO: 408702 - DNA, 592 bp, Homo sapiens
  misc_feature: GZ8MTXP02HEWZJ.4.79.H02.1.454.CMB.2.raw
  modified_base (210)..(210): a, c, t, g, unknown or other
  modified_base (376)..(376): a, c, t, g, unknown or other
  modified_base (555)..(555): a, c, t, g, unknown or other
  modified_base (557)..(557): a, c, t, g, unknown or other
  modified_base (559)..(559): a, c, t, g, unknown or other
  modified_base (561)..(563): a, c, t, g, unknown or other
  modified_base (566)..(566): a, c, t, g, unknown or other
  modified_base (568)..(570): a, c, t, g, unknown or other
  modified_base (572)..(577): a, c, t, g, unknown or other
  modified_base (579)..(584): a, c, t, g, unknown or other
  modified_base (586)..(589): a, c, t, g, unknown or other
  modified_base (591)..(592): a, c, t, g, unknown or other
tcagagcactgtagcacgaccggtgctcgatttagtgtcacacgaagggaaggggctggagtggctttcatacattgatagtagtgggaagatcatatactacgcagactctgtgaagggccgattcaccgtctccagagacaacgccaacaactcactgtttctgcaaatggacagcctgagagccgaggactcggcttgtttattacngtgcgagagattcgaggtatttgatgctagcgagggcctactatgactacgtggggccagggaaccaaggtccaccgtctcctcagcccctccgaaccgaacggggcccccaagttccgggtccctttacccccccgtggcccgcccttcgcctcccgaggacccnccacccgtccggagacgccaacgcggccggccctggggtcctccggtccctgggtacccgaaacgggtacccttaacccgtttccccgtaacgtaacggtccgtcccgtttccggtaacggacgggccgggggttcctacggggacccgtaaaacggggccgaaccgtaagttaacggngngngnnngcngnnncnnnnnncnnnnnncnnnncnn

SEQ ID NO: 408703 - DNA, 501 bp, Homo sapiens
  misc_feature: GZ8MTXP01B16FZ.3.82.H05.1.454.CMB.2.raw
  modified_base (271)..(271): a, c, t, g, unknown or other
  modified_base (492)..(492): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaancccctgagttcctgatgtctgctgcatccaccctgcaaagtgacgtcccatccagattcagcgtcaagtgaatcgtgggacagagttcactctcacatcagcagcctgcagcctgaagtattttgactaactttacttattcgtacaacgaggctagactagtcctcccgctctacgtttcgggcggagggaccgaaggttggagataacaacgaactggngctgcaacc

SEQ ID NO: 408704 - DNA, 546 bp, Homo sapiens
  misc_feature: GZ8MTXP01DG7MC.3.82.H05.1.454.CMB.2.raw
  modified_base (278)..(278): a, c, t, g, unknown or other
  modified_base (343)..(343): a, c, t, g, unknown or other
  modified_base (376)..(376): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtagggacagagtcgctatgacttggtcgggcgactcgcggttttaacagtatggttagtctggtatcagcaagaaaccagggaaacncccctgagttcctgatgtctgctgcatccacctgacaaagtgacgtccatccagattcagcgtangtgatcgtaggactagtactcactctacactancagcacgctcgacgacgacgtagtaagtagtttactactaacttaacttacttacgtacaacgtacgtacgtacgtacgtacgtcctcccgtccttccgtacgttccgggtacgggtacgggacggacggttaggaagtacgtaacgaaacgtacgttagtcgttcgtcg

SEQ ID NO: 408705 - DNA, 584 bp, Homo sapiens
  misc_feature: GZ8MTXP01DPW8L.3.82.H05.1.454.CMB.2.raw
  modified_base (251)..(251): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcgtggtttcgtgttaggctattacaaaggtgtcagtgtgaggtgcaggtggtggagactggaggaggcttgatccagcctggggggtcctgagactctcctgtgcncgctctcgtctcacgtcagtagacacgctacatgcacgtcggtccggccgacgcgtacgacgggagggacggtggtaggtggtcgtacgtagttacttactatacgtacgtacgtaactactaactactaccgtacccgtacgacggacgacgtaactactactacacgacgacgtacgtacgtacgaacgtaacgtacgtactactactaactaacgaacaacgtacgacgacgacgacgacgacgtacgttacgttactgtgtgagagtagttagtaggtggttcgggttccgttccgtccgtacgttcgttctcgttcgtcgttcgtcgg

SEQ ID NO: 408706 - DNA, 537 bp, Homo sapiens
  misc_feature: GZ8MTXP01BVOV9.3.82.H05.1.454.CMB.2.raw
  modified_base (472)..(472): a, c, t, g, unknown or other
  modified_base (475)..(475): a, c, t, g, unknown or other
tcagagacgcactccacgaccggtgctcgatttagtcgagctctctcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccgccaggctccgaggggaggggctgggagtgggtctcagttattacaattctggtaccacataactactccgaccccgtgaacgggccgattaacatctccagagacgattccgagaacacggtgtatcttacaaatgaacaacctgagagccgagacacggccgtttatactgtgcgagngtnttcggagttgggttcgggaccttcgcccttggttctattcgatcgttcgtcggggccgtcgg

SEQ ID NO: 408707 - DNA, 545 bp, Homo sapiens
  misc_feature: GZ8MTXP01ER0JU.3.82.H05.1.454.CMB.2.raw
  modified_base (423)..(423): a, c, t, g, unknown or other
  modified_base (432)..(432): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcactggtccgccaggctccgaggggaaggggctgggagtgggtctcagttacttacaattctggtaccaacataacctactcccgacccgtgaacgggccgattaaaccatctccaagcgaacgattaccgaanaacacggtnatcttacaaatggaaacaactgagacgccgacgacacggtccttatactgtgcgagagtattcgaggtggttcgggccttcgaaccctggttctacttcgatcttcgtcgggg

SEQ ID NO: 408708 - DNA, 502 bp, Homo sapiens
  misc_feature: GZ8MTXP01CM8WJ.3.82.H05.1.454.CMB.2.raw
  modified_base (420)..(420): a, c, t, g, unknown or other
  modified_base (439)..(439): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccacctgacaaagtgacgtcccatccagattcagcgtcaagtgaatcgtagggacagagttcactctcacatcagcagcctgcagcctgaagtatttgactaactttacttattgtacaacnggctgactagtcctcccgntcctacgtttcgggcggagggaccgaagggttggagataacaaacgaactgtggctgctaacc

SEQ ID NO: 408709 - DNA, 543 bp, Homo sapiens
  misc_feature: GZ8MTXP01DR3D0.3.82.H05.1.454.CMB.2.raw
  modified_base (280)..(280): a, c, t, g, unknown or other
  modified_base (531)..(531): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttggtcgggcgactcgtcggttttaaacagtattgggttagtctggtatcagcaagaaaccagggaaacncccctgacgttcctgatgtctgctgcactcccaccctgacaaagtggactcccatccagtattcagctcaaagttcgaagtcgtagggacaggtattcactctacacatcagcagccctgcaacgcctagaaatattttacgactaaactttactaatttagtacaaacgacggctagactagtcctcccgctctacgtttcgggacgggttacgggaccgaagggttgagataacgaaacgaacgttggnggctcgctaacg

SEQ ID NO: 408710 - DNA, 506 bp, Homo sapiens
  misc_feature: GZ8MTXP01DL0SP.3.82.H05.1.454.CMB.2.raw
  modified_base (270)..(270): a, c, t, g, unknown or other
  modified_base (427)..(427): a, c, t, g, unknown or other
  modified_base (496)..(496): a, c, t, g, unknown or other
tcagagacgcactccacgaccggtgctcgatttagtcgagctctctcgcggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaancccctgagttcctgatgtctgctgcatcccacctgacaaagtggactcccatccagattcagcgtcaagtgaatcgtgggacagagttcactctacaccatcagcagcctgctagcctagaacgtattttcgactaaactttactattgtacaacgnggctagactagtctcccgctctactttcgggcggttaggaccgaagggttgagactaacaaacgctggngctgctaacc

SEQ ID NO: 408711 - DNA, 515 bp, Homo sapiens
  misc_feature: GZ8MTXP01DALZC.3.82.H05.1.454.CMB.2.raw
  modified_base (359)..(359): a, c, t, g, unknown or other
  modified_base (482)..(482): a, c, t, g, unknown or other
tcagagacgcactccacgaccggtgctcgatttagtcgagctctctcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaggggctgggagtgggtggcagttatgtccacatgatggaaaagaaaaaatntacgcagactccctgaagggtcgattcaccatctccagagacaattaccaacaacaccctagtatttggacaaatgaacagcctgagaactgaagacacggctaatcttatacttgtgcgagngatcagtccggacgacgaatgaacgttaacggg

SEQ ID NO: 408712 - DNA, 563 bp, Homo sapiens
  misc_feature: GZ8MTXP01DZXIF.3.82.H05.1.454.CMB.2.raw
  modified_base (429)..(429): a, c, t, g, unknown or other
  modified_base (503)..(503): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgaggggagggctggagtgggtctcagtttacttacaattctgtaccaacatctactccgaccccgtgaacgggccaattaaacccatcgtaccagacgacgattacccgaagaacacggtntatcttacaaatcggaaacaaccgtgaacgagcccgaacgactaccgggtccgtttaatactgtgaacgagagnttcggaggttgggttaccgggccttcaacccgttggttcctactcgatcgttgtcggggg

SEQ ID NO: 408713 - DNA, 529 bp, Homo sapiens
  misc_feature: GZ8MTXP01CEZ9G.3.82.H05.1.454.CMB.2.raw
  modified_base (276)..(276): a, c, t, g, unknown or other
  modified_base (345)..(345): a, c, t, g, unknown or other
  modified_base (494)..(494): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttgtcgggcgactcgtcggtttaacagtatggttagtctggtatcagcagaaaccagggaancccctgagttcctgatgtctgctgcatcccaccctgacaaagtggacgtccatccagtattcagcgtcngtgaaatcgtgggacagacgttcactctcaccatcagcagcctagcagcctgaacgtattttgactaacttactattgacaactggctagactacggtcctcccggcttctacgtttcgggacgggtacgggaccgagggttacggaanacgtaaccgaaacggtacgttggtcgggctaaccg

SEQ ID NO: 408714 - DNA, 562 bp, Homo sapiens
  misc_feature: GZ8MTXP01D82AJ.3.82.H05.1.454.CMB.2.raw
  modified_base (422)..(422): a, c, t, g, unknown or other
  modified_base (489)..(489): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcacgtgggtccgccaggctccgaggggaggggctgggagtgggtctcagttatttacaattctaggtaccacataacctactccgacccgtgaacgggccaataaccatctccagacgacattccgaagaacacgggtntatcttacaaatgaacaaccgtgagacgccgagaccgacggtccgtttaatactgtgcgagaacgtnttcggagttcgggttacggggaacccttcgacccttggttcctacgttcgactcgttcgtcgggggcctcggg

SEQ ID NO: 408715 - DNA, 607 bp, Homo sapiens
  misc_feature: GZ8MTXP01ED51O.3.82.H05.1.454.CMB.2.raw
  modified_base (358)..(358): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcacgtgggtcccgccaggcctccgagggggaaggggctgggagtgggtctcagttattacaattctggtaccanataacctactccgacccgtgaacgggccattaaccatctacagagacgattaccgaagaacgtacggtagtactacttacaaattacgaaaccaaccgttagaacggacgacccgaacgaaccgtaccgggtaccgttttaatacctgtggaccgagaacgtagttcggaaggttcgggttaccggggacccttccgttcccttgggttccttacgttcggtactccgttcggtcggggccggttccgg

SEQ ID NO: 408716 - DNA, 581 bp, Homo sapiens
  misc_feature: GZ8MTXP01B1H87.3.82.H05.1.454.CMB.2.raw
  modified_base (308)..(308): a, c, t, g, unknown or other
  modified_base (545)..(545): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatcgtggtaggggacagagtcgctatgacgttggtcggggcgacttcggtacgggtttttaaacaggtattgggtttagtctgggtatcagcaaaggaaaccgagggaaacgcccctgacgttccngatgtctgctgcactcccaccctgacaaaggtggacgtcccatccagtacttcgagtcgtacaagtagaactcggtaggggactaggtacgttccacttctacaccatcgagcacgcctgacacgcctagtaagttatttacgacttaaactttacttattacgtacaaacgcgtctacgactacgtccctcccgctcctacggttcgggacgggttacggaaccgaagggttgganaacgtaacgaaacgtaacgtggtcggctgcctaacc

SEQ ID NO: 408717 - DNA, 597 bp, Homo sapiens
  misc_feature: GZ8MTXP01DGLCN.3.82.H05.1.454.CMB.2.raw
  modified_base (275)..(275): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgtcggttttaacagtatggttagtctggtatcagcaagaaaccagggaaacnccctgagtcctgatgtctgctgcatccacctgacaaagtgatcccatccagattcagcgtcaagtgaatcgtgggacagattcactctacaccatcaagcaagcctcgcacgacctagaagtatttagtacgtaaactttaaccttaattagttactaaaccaaggaccttaggtacgaacgtaccgtccccgtcccgtcctaccgtttaccgggtaccgggaacggggtaaacccggtaaacgggttaacgggttaacgggttaaaacgtaaacgtaaaacgtaaacgtacggtacggttacgtaacgttaaccgtaaccg

SEQ ID NO: 408718 - DNA, 536 bp, Homo sapiens
  misc_feature: GZ8MTXP01EOX54.3.82.H05.1.454.CMB.2.raw
  modified_base (239)..(239): a, c, t, g, unknown or other
  modified_base (292)..(292): a, c, t, g, unknown or other
  modified_base (347)..(347): a, c, t, g, unknown or other
  modified_base (379)..(379): a, c, t, g, unknown or other
  modified_base (382)..(382): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacngtatggttagtctggtatcagacagaaaccagggaaacgcccctgacgttccngatgtctgctgcactcccaccctgacaaagtgacgtccactccagatcagcgtangtagaagtcgaggacagtactcactcacacancancacgctgacacgtctagtagttacgtttacgtacttaacttactatcgtacaacgtagctacgactcgtccctccgtcttccgtacggttcgggacgggtaacgggacgagggttagaagtaacgtaacgaaacgtacgttggtcggttcgtcg

SEQ ID NO: 408719 - DNA, 559 bp, Homo sapiens
  misc_feature: GZ8MTXP01AMYL2.3.82.H05.1.454.CMB.2.raw
  modified_base (314)..(314): a, c, t, g, unknown or other
  modified_base (443)..(443): a, c, t, g, unknown or other
  modified_base (487)..(487): a, c, t, g, unknown or other
  modified_base (491)..(491): a, c, t, g, unknown or other
  modified_base (538)..(538): a, c, t, g, unknown or other
tcagagacgcactccacgaccggtgctcgatttagtcgagctctctcgcggggggagaggagcccagcactgggatttcgaggtgtttccattcggtgatcagcactgaacacagaggactcaccatggagttttggctgagcgtggttttcgtgtagctattacaaaggtgtcagtgtgaggtgcaggtggtggagactggaggaggcttgatccagccgtgggggtccctgagactctcctgtgcagcctctggcttcaccgtcagtagcagctacatgcacgtggccgccaggctccgaggggaacggggngtgggaggtgggtcgtctagttatttactaacttactggtaccacactaactactccgacccgtacgacggaccgactaaccactctaccagagacgactaccgagaacgacgtagtatacttactaanagaacaaccgagagacgacgacgacgacgacgttactactgtgngagngattgtacgttggtcgggtacgttcgttccgttcgttctacgtcgtntcgttcgtcgggttcgtccgg

SEQ ID NO: 408720 - DNA, 557 bp, Homo sapiens
  misc_feature: GZ8MTXP01AEDP3.3.82.H05.1.454.CMB.2.raw
  modified_base (361)..(361): a, c, t, g, unknown or other
  modified_base (406)..(406): a, c, t, g, unknown or other
  modified_base (421)..(421): a, c, t, g, unknown or other
  modified_base (433)..(433): a, c, t, g, unknown or other
  modified_base (450)..(450): a, c, t, g, unknown or other
  modified_base (484)..(484): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggcctccgagggggaaggggctgggagtggggtctcagtttatttacaattctggtaccanataactactccgaccccgtgaacgggccattaaccatctccaganacgattccgagaacncgtgtatcttanaaatgaaacacgtgagngaccgacgacgacggccgtttatactgtgcgagngagttcggaggttcggtccggggaccttcgaccccttggttcctacgttcgatccgttcgtcggggccgtcgg

SEQ ID NO: 408721 - DNA, 605 bp, Homo sapiens
  misc_feature: GZ8MTXP01C5J7J.3.82.H05.1.454.CMB.2.raw
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttggtcgggcgactcgtcggttttaacagtatggttagtctggtatcagcaagaaaccgagggaaacgcccctagagttcctgatgtctgctgcatcccacctgacaaagtggactcccatccagattcagcgtcaagtgaaatcgtagggacagacgtcactctacacatcagcacgcctgcacgcctagaagttattttacgacttaaactttactatttcgtactaaacgtacgggtcttaggaacctacggttccctccccggtctttacccgttaaccggttttccgggggaaccggggaacggggttaaacccggttaaggggttacgggaaagtaaacgttaaccgaaaacccggtaacgttgggttaaccgggcttaaccggg

SEQ ID NO: 408722 - DNA, 697 bp, Homo sapiens
  misc_feature: GZ8MTXP01DZN0P.3.82.H05.1.454.CMB.2.raw
  modified_base (258)..(258): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagtttggctgagcttgggttttccttgttgctatttcaaaaggtgtccagtgtgaggtgcaggtggtggagactggaggaggcttgatccagccgtgggggtccctgagctctcctgtgcagcctntggccttcaccgtcagtagcagctacatgcacgtcggtcccgccgaggcctccggaggggacggggctgggagtgggtctcgtagttactttacaatttcgtaggtacccaactactaacctaccgtacccgaccccggtagaacgggtccaaatttaacccattccctaccgaaggacgtaacgtacgttaccccggaagtaaaccgtaccgggttagttaacttaccttaacaaaacgttacgggaaaacctacccgtagaaacggtaccgacccggtaaacgaaccgtaccgggtacccgttttaattaaccgtggtacggaacgtaaggaacggtacgtttccgggaaagggttcggggttacccgggttaccttcccggtaaccccgttgggtttaaccctacgttcgttaacgttcccgttcgggtccggggg

SEQ ID NO: 408723 - DNA, 693 bp, Homo sapiens
  misc_feature: GZ8MTXP01B5TAR.3.82.H05.1.454.CMB.2.raw
  modified_base (272)..(272): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctcgtggcttcaccgtnagtagcagctacatcgcacgtcgggtcccgccgaggcctaccggaagggggaacgggggctggggaggttggggtccttacgtaagtttatttaacaaactttccgtaggtaacccaactacttaaacccttacccgtcccggaaccccgtagggaaaccggggtaccctaatttaaacccattaccctaccgaagaacgacgtagttacccgaagaaaccgtacgggtattactacttaacaaaagttacgaaaccaaccgtaggaacgaaccggacccgaacgaaccgtaccgggtacccttttaagttaccgtggtacggacgtaaggaacgtagttcgggaggtttcggggtacccgggtaaccttccgttacccgttggttcctacgttcgacttcgttcgggtcgggttcgtccg

SEQ ID NO: 408724 - DNA, 595 bp, Homo sapiens
  misc_feature: GZ8MTXP01BG29T.3.82.H05.1.454.CMB.2.raw
  modified_base (402)..(402): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtcgggtccgccaggctccgaggggaaggggctgggagtgggtctctagtttacttacaattctggtacccaacactctactcccgacccgtgaacgggccaattaaccntcctaccagacgacgattacccgaagaacgacggtagtatcttacgaaatcgggaaacctaaccgtgacgacgacccgacgaccgacggtccctttaataccgtgtgaacgaagagtacgttcgggaaggttcggggttccggggcccttaccgaaccccgttggtccttacgtcgatccgttcggtcggggg

SEQ ID NO: 408725 - DNA, 621 bp, Homo sapiens
  misc_feature: GZ8MTXP01DWJVL.3.82.H05.1.454.CMB.2.raw
  modified_base (455)..(455): a, c, t, g, unknown or other
  modified_base (460)..(460): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttccaccgtcagtagcagctacatgcacgtcgggtcccgccgaggcctaccggaagggggagggggcgtgggaggtgggtcttacgtagtttactttactaactttcgtaggtacccactactaacctaccgtcccgacccgtggaaacgggccgtaattaaccatcctacgagacgacgattccgaagaaacncggtntatactacgaaatcgaacaaccgtggaacgacgaccgaacgcgtacggtacctttatactgtcgacgtagaagtagttcggaggttcgggttaccgggccttaccgttccctttgggttaaccttacgttcgacttccgttcggtcgggggccgttccggg

SEQ ID NO: 408726 - DNA, 594 bp, Homo sapiens
  misc_feature: GZ8MTXP01CY8IW.3.82.H05.1.454.CMB.2.raw
  modified_base (444)..(444): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgagggggaagggggctgggagtgggtctcgtagtttattacaacttcgtaggtaccactataaacctactcccgacccgtgaaacgggccgaattaaccatctccagacgacgattaccgaagaaacggtgtatctanaaatcgaaacactggacgagaccgacgacacggtccgtttatacgtgtgacgagagtgttcgaggttcggttccggggtaacctccgttacccgttggttccttaacgttcgtaacttcgttcggttcgggggtcccgttcggtaacccg

SEQ ID NO: 408727 - DNA, 545 bp, Homo sapiens
  misc_feature: GZ8MTXP01BUIT2.3.82.H05.1.454.CMB.2.raw
  modified_base (295)..(295): a, c, t, g, unknown or other
  modified_base (398)..(398): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcacgtgggtccnccaggctccgaagggggaggggctgggagtgggtctctagttatttacaattctggtaccacataactactccgacccgtgaacgggccatacatctacaganacgatccgagaacacggtgtatctacaaatagaacaaccgtgacgagcccgaacgaccacggtccgtttaatactgtgcgagaagattcggagttgggtcggggaccttcgcccttggttctactcgatcttcgtcggggccgtcgg

SEQ ID NO: 408728 - DNA, 563 bp, Homo sapiens
  misc_feature: GZ8MTXP01CG81X.3.82.H05.1.454.CMB.2.raw
  modified_base (396)..(396): a, c, t, g, unknown or other
  modified_base (431)..(431): a, c, t, g, unknown or other
  modified_base (495)..(495): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctaccgaggggaaggggctgggagtgggtctcagttatttacaattctggtaccacataactactcccgacccgtgaacgggccgaattaaccntacctccaagagacgatacccgagaaacacgggtntatcttacaaatgaaaccaacgtgaacgacgacccgacgaacacggtccgttttaatacgttgngcgagaagtattcgaggttggttccgggacttccgaccgttgtctattcgatcgttcgtgggccgtcg

SEQ ID NO: 408729 - DNA, 743 bp, Homo sapiens
  misc_feature: GZ8MTXP01D1V2G.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtcccgccgaggcctaccggagggggaagggggctggggaggtggggtctacgtagtttatttactaacttcgtacggtaccactactaaaccctacctcccggacccgtagggaaacgggtcccgtaacttaaaccacgttacctacccgaaggtacgaaccgtaacttacccggaaagtaaacgtaccgggtattaactaccttacaaaaattacggaaaaccctaaaccggggttggaaacggaaccggacccccggaaacgtaacccgtaccggggtttaccgtttttaaactaccgtggtacgggtaccggaaggtaacggtaacgtttccgggtaaggggtttccggggttaccccggggaaccctttacccgttcccggttttcgggtttaacctaccgtttccggtattcccggttcgggttccggggggttccccgtccggg

SEQ ID NO: 408730 - DNA, 551 bp, Homo sapiens
  misc_feature: GZ8MTXP01EMQPK.3.82.H05.1.454.CMB.2.raw
  modified_base (293)..(293): a, c, t, g, unknown or other
  modified_base (531)..(531): a, c, t, g, unknown or other
tcagagacgcactccacgaccggtgctcgatttagtcgagctctctcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccnccaggctccgaggggaaggggctgggagtgggtctcgtagttatttacaattctaggtaccacactaaactactcccgaccccgtgaaacgggcccgaattaaccatctccagagacgattccgagaacacggtgtatctacaaatgaacaacgtgagacgaccgacgacgacggtcgtttatactgtgcgagaagattcggagttggtcggggacttcgcccttggttctacttcgntcgttcgtcggggccgtcgg

SEQ ID NO: 408731 - DNA, 534 bp, Homo sapiens
  misc_feature: GZ8MTXP01BBJW1.3.82.H05.1.454.CMB.2.raw
  modified_base (418)..(418): a, c, t, g, unknown or other
  modified_base (473)..(473): a, c, t, g, unknown or other
tcagagacgcactccacgaccggtgctcgatttagtcgagctctctcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtcccgccaggctccgaggggaggggctgggagtgggtctcagttatttacaattctggtaccacataactactccgaccccgtgaacgggccattaaccatctccagagacgattccgagaacacggtntatcttacaaatgaacacgtgagagccgacgacacggtctttatactgtgcgagngtattggagttggtcgggacttcgccttggtctacgttcgatcgttcgtcggggccgtcgg

SEQ ID NO: 408732 - DNA, 573 bp, Homo sapiens
  misc_feature: GZ8MTXP01EV3T6.3.82.H05.1.454.CMB.2.raw
  modified_base (552)..(552): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctcgtggcttcaccgtcagtagcagctacatgcacgtcgggtcccgccgaggcctccgagggggaagggggctgggaggtgggtctcagtttattacaacttctaggtaccactactaactactccgaccccgtgaacgggcctaattaaccatcctacagagacgtactccgagaactacggtgtactacttacaaatacgaacaaccgtgagacgccgacgacacggtctttatactgtgcgagaatattcggagttcggtcgggtaccttcgttcccgttggttcctacgttcgnttcgttcgtcggggccgtcgg

SEQ ID NO: 408733 - DNA, 538 bp, Homo sapiens
  misc_feature: GZ8MTXP01EQ8DR.3.82.H05.1.454.CMB.2.raw
  modified_base (277)..(277): a, c, t, g, unknown or other
  modified_base (290)..(290): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagtatggttagtctggtatcagcagaaaccagggaaacncccctgagttccngatgtctgctgcatcccacctgacaaagtggactcccatccagattcagcgtcaagtgaatcgtgggacagagttcactctcacatcagcagcctgcagcctagaagtatttgactaaacttactattcgtacaacaggtctgactacgtcctcccgcttcgtaaccgtttcgggacggaacgggaaccgttaaggggttacgggaaggaattaaccgaaaaccggaacttacgggttggcgtaaccg

SEQ ID NO: 408734 - DNA, 591 bp, Homo sapiens
  misc_feature: GZ8MTXP01A5XJF.3.82.H05.1.454.CMB.2.raw
  modified_base (296)..(296): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactgggtcccnccaggctccgaggggaaggggctgggagtgggtctcaggttatttacaattctggtaccacataacctactcccgacccgtgaaacgggcccgaattaaccatcctaccaggacgaacgacttacccgagaaaccgacgggttgtaactacttacaaaagtcgaaaccaaccgtagaagacgccgacgacacggtccgtttatacgtgtgcgagaagtagttcggaggttcgggttacggggacccttcgacccgttgggttcctacttcgtatcgttcgtcgggggccgtcggg

SEQ ID NO: 408735 - DNA, 636 bp, Homo sapiens
  misc_feature: GZ8MTXP01EYVEA.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtggtccgccaggctccgaggggaagggctgggagtgggtctcagttactttacaattcgtagtaccaacataactacctccgaccccgtgaacgggccgattaaacccatctaccagagacgattacccgagtaacacgggtatactacttaacaaaactaggaaactaaccgtagaacggaacggcccggaaaccgaacgaaccgggtacccgtttaattaaccgtggtcggaacgtaaggttagaagtttcggaaagggttcggggttaccgggggttccttacccggtaaccccgttgggtttaaccttaccgttcggttaacttcgttccggtccggggg

SEQ ID NO: 408736 - DNA, 599 bp, Homo sapiens
  misc_feature: GZ8MTXP01BUUNS.3.82.H05.1.454.CMB.2.raw
  modified_base (298)..(298): a, c, t, g, unknown or other
  modified_base (438)..(438): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactggtccncaggctccgaggggaaggggctgggagtgggtctctagttactttacaatttctaggtacccaaacataacctactcccggaccccgtagaacgggccaattaaccatctccaagagacgattaccgaagaacacgggtntactcttaacaaatcgggaaactaaccgtgacggaacgcccgaacgacgtaccgggtccgtttaatacctgtgaaccggagagtacgttcggaaggttcgggttaccggggccttccgtaaccccgttggtttcctacgttcgattccgttcggtcggggg

SEQ ID NO: 408737 - DNA, 581 bp, Homo sapiens
  misc_feature: GZ8MTXP01C0K79.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtcccgccaggcctccgaggggaggggctgggagtgggtctcgagttatttacaattctaggtaccacataacctacctcccgacccgtgaacgggccgaattaaccatcctccagagacgacttccgaagaacgtacggtagtatcttacaaatacgaaaccaaccgtgaacgacgccgaacgaccacggtacccgtttatacgtgtgcgagaagtagttcggaggttcgggttacggggccttcgacccttggttcctacgttcgattcgttcgtcggggccgtcgg

SEQ ID NO: 408738 - DNA, 743 bp, Homo sapiens
  misc_feature: GZ8MTXP01DJYQQ.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtcgggtccgccgaggctaccggagggggaagggggctgggagttggggtctcgtagtttaactttacaaatttcgtacggtaacccaaactattaacctaccgtaccccggaaccccggttagggaaaccggggacccgtaaacttaaacccacttacctaccgaaggaacgaaccgtaacgtttacccggaaagtaaaccgtaccggggttatacttaccttaaccaaaagttacggggaaaccctaaacccgttaggaacggaacggaccccggaaacggaccgtaaccggggttacccgttttaagttaaccgtggttcggaacggtaaggttaacggtacgttcgggtaagggttcggggtttacccgggggttacccttcccgtaaccccgttcgggtttaaccttaaccgttccggttactttcccggttcgggttcccggggg

SEQ ID NO: 408739 - DNA, 540 bp, Homo sapiens
  misc_feature: GZ8MTXP01ED80Z.3.82.H05.1.454.CMB.2.raw
  modified_base (254)..(254): a, c, t, g, unknown or other
  modified_base (420)..(420): a, c, t, g, unknown or other
  modified_base (472)..(472): a, c, t, g, unknown or other
tcagagacgcactccacgaccggtgctcgatttagtcgagctctctcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctntggcttcaccgtcagtagcagctacatgcactgggtccgccaggcctccgagggggaaggggctgggagtgggtctcagttattacaattctggtaccacataactactcccgacccgtggaagggccattaaccatctccagagacgattcccgagaacacggtntatcttacaaatgaaacacgtgagagccgagacaccggtcgtttaatactgngcgagaagattcggagttgggtcgggaccttcgccttggttcacgttcgatcgttcgtcggggcctgg

SEQ ID NO: 408740 - DNA, 554 bp, Homo sapiens
  misc_feature: GZ8MTXP01CZMT3.3.82.H05.1.454.CMB.2.raw
  modified_base (413)..(413): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagactggaggaggcttgatccagcctgggggtccctgagactctcctgtgcagcctctggcttcaccgtcagtagcagctacatgcacgtgggtcccgccaggctccgagggggaagggggctgggagtgggtctcgagtttatttacaatttctaggtaccacactaacctactcccgaccccgtaggaacgggccgattaaccatcctccaganacgattccgaagaacgacggtgtatcttacaaatgaacacgtgagacgaccgacgacgacggcgtttaatctgtgcgagaagtgttcgagttgggttcgggcttcgccttggttcacttgactcgttcgtggggccgtcgg

SEQ ID NO: 408741 - DNA, 535 bp, Homo sapiens
  misc_feature: GZ8MTXP01B430B.3.82.H05.1.454.CMB.2.raw
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttggtcgggcgactcggtcggttttaacagtatgggttagtctggtatcagcaagaaaccagggaaacgcccctgagttcctgatgtctgctgcatccaccctgacaaagtgactccatccagattcagcctcaagtgaatcgtaggggacagtagttcactctcacatcagcagcctgcagcctagaagtatttgactaaactttacttaattcgtacaacgaggctacgactacgtcctaccccgcttaaccgtaccgttcgggcggagggaccgaagggttcgagactaacgaaacgtaactacggtggctaacgccgtaacc

SEQ ID NO: 408742 - DNA, 692 bp, Homo sapiens
  misc_feature: GZ8MTXP01DOV1G.3.82.H05.1.454.CMB.2.raw
  modified_base (493)..(493): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtgggaggaggcttgatccagccgtgggggtccctgagactctcctgtgcagcctctggcttcaccgtcagtagcagctacatgcacgtcgggtccgccgaggctccgagggggaaggggctgggagtgggtctcgtagtttactttacaatttcgtacggtacccaaactacttaacctaccgtacccgaaccccgggttaggaaacgggacccgtaaacttaaacccacttaccgtacccgaaaggtacgaaccgtaactttacccggaagtaaaccgtacgggtnttaactactttaacaaaacgttcggggaaaacctaaccgttagaaccgacggaacccgaacgtaccgtaaccggggttcctttaagtaccgtggtgaacgagttagtacgttcgggaacgggtttcggggttacccggggcccttacgtaaccccgtttggtttccttaacgttcgacttccggttcgggttccggggg

SEQ ID NO: 408743 - DNA, 561 bp, Homo sapiens
  misc_feature: GZ8MTXP01CF07R.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgaggggaagggctgggagtgggtctcgtagtttattacaacttctaggtaccacataaacctacctcccgacccgtgaacgggccattaaccatcctaccagacgacgtacttaccgagaacgtacggtgtatcttacaaatgaacaacgtgagacgaccgacgacgacggtccgtttatacgtgtgcgagaagtattcggagttcggtcgggcttccgccttggttctacgttcgatcgttcgtcgggcgtcgg

SEQ ID NO: 408744 - DNA, 541 bp, Homo sapiens
  misc_feature: GZ8MTXP01BVBNP.3.82.H05.1.454.CMB.2.raw
  modified_base (446)..(446): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggattcaccttcagtagctatagcatgaactgggtccgccaggctccgagggggaaggggctggagtgggtctcatccattagtagtagtagtagttacataatactaacgcagactcagtgaaagggccattcaccatctaccagacgacaacgccaaagactcacttgatctgacaaatgaaaccngcctagagagcccgaggccaagggcttgtacgttattacgtgttgcgttaggttttggttggggcggtataggcgtaagggcgggtaacccgggg

SEQ ID NO: 408745 - DNA, 520 bp, Homo sapiens
  misc_feature: GZ8MTXP01BF7UP.3.82.H05.1.454.CMB.2.raw
  modified_base (272)..(272): a, c, t, g, unknown or other
  modified_base (433)..(433): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaacnccctagagttcctgatgtctgctgcactccaccctgacaaagtggactcccatccagattcagcgtcaagtgaatcgtgggacagtagttcactctacacatcagcagcctgacacgcctagaagtattttacgactaaactttactattacgtacaacgnggctagactacgtcctcccgtctcgtacgtttcgggacggagggaccgaagggttcgagactaacaaacgtaactggtggctgcaac

SEQ ID NO: 408746 - DNA, 688 bp, Homo sapiens
  misc_feature: GZ8MTXP01BQJRU.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctggcttcaccgtcagtagcagctacatgcacgtgggtcccgccgaggcctaccggaagggggaacgggggctgggagttcggggtctcgtagtttatttactaacttctaggtaccactactaacctacctcccggacccgtaggaacgggcccgtaattaaccagtcctaccgaagaacgaccgtattacccggaagtaaaccgtacggttgtaactccttaacaaaagttcgaaaaccctacggtagaaacggaccgaccccgaacgaaccgtaccggttaccgttttaagttccgtaggtacgacggtaagtaacgtaacgtttccgggaagggtttccgggggttaccggggaacccttccgttcccgtttcgggttaacttacccgttcgtacgttccgttccgggttcgggggttcccgtcggg

SEQ ID NO: 408747 - DNA, 560 bp, Homo sapiens
  misc_feature: GZ8MTXP01CLCL0.3.82.H05.1.454.CMB.2.raw
  modified_base (437)..(437): a, c, t, g, unknown or other
  modified_base (484)..(484): a, c, t, g, unknown or other
  modified_base (490)..(490): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttggtcgggcgtacgtcgtacggttttaacaggtattggttagtctggtatcagacaagaaaccgaagggaaacgcccctgacgttcctgatgtctgctgcactcccaccctgacaaagtcggacgtcccactccagtattcagtcgtacaagtagtaatcgtaggggacagggtacttcacttcctacaccatccagcacgcctgcacgtcctagtaacttnttttacgacttaaactttactattgacaacgtaggctgactcgtccncccgtnttcgtacgttcggacggtaacgggaccgttagggttcgaagactaacgaaacgtacgttaggtcggctcg

SEQ ID NO: 408748 - DNA, 512 bp, Homo sapiens
  misc_feature: GZ8MTXP01BQ6GS.3.82.H05.1.454.CMB.2.raw
  modified_base (484)..(484): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgtcggttttaacagtagtggttagtctggtatcagcaagaaaccgagggaaacgcccctgagttcctgatgtctgctgcactccacctgacaagtgacgtccatccagattcagcgtcaagtgaatcgtagggacagtacgttcactctcacatcagcagcctgcagctagaagtatttgacttaactttactattagtaccaacgaggctagactgtcctcccgctcgtacgttcgggacggacgggacaagggttgganactaacaagaacgttggaggctgctaac

SEQ ID NO: 408749 - DNA, 637 bp, Homo sapiens
  misc_feature: GZ8MTXP01EKFS4.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtggaggaggcttgactccagccgtgggggtccctgagactctcctgtgcagcctctggcttcaccgtcagtagcagctacatgcacgtgggtcccgccgaggcctaccggaagggggaacgggggctggggagttgggtctcgagtttacttacaaatttctggtacccaactataacctacctcccgaccccgtgaacggggtccattaaaccatctacgagagacgattacccgaagaaacacgggtatatcttaacgaaattcggaaactaaacccgtgaacgaacgaccccgaacgacctaaccgggtcctttaattaccgtggtgaacgtaaggagtaattcggaaggttcggggttaccggggacccttccgtaaccccttgggtttcctaaccgttcggaacttcccgttcggtccgggggg

SEQ ID NO: 408750 - DNA, 549 bp, Homo sapiens
  misc_feature: GZ8MTXP01AS1DA.3.82.H05.1.454.CMB.2.raw
  modified_base (419)..(419): a, c, t, g, unknown or other
  modified_base (424)..(424): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgagggggagggggctgggagtgggtctcagttattacaattcgtgtaccacataacctactcccgacccgtagaacgggccattaaccatcctacagagacgatccgagaacncggtntatctacaaatgaaacacgtgagacgccgaacgaccacggtcctttaatactgtgcgagaagtattcggagttgggttaccgggcttcgccttggtctacttcgattcgttcgtcggggcctcgg

SEQ ID NO: 408751 - DNA, 584 bp, Homo sapiens
  misc_feature: GZ8MTXP01EK2PB.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtggggggtccctgagactctcctgtgcagcctctggcttcaccgtcagtagcagctacatgcacgtcgggtcccgccaggcctaccggaagggggaagggggctgggaggtgggtctctagttatttacaacttctaggtaccactataacctacctccgacccgtgaacgggccgaattaaccatctccagagacgattccgagaacacggtatatacttacaaatacgaacaacgtgaacgacgaccgacgacgacggtcgtttaatacgtgtacgcgagaacgtagttcggagttcgggttccgggaccttcgacccgttggttctacgttcgatcgttacgtcggggcctaagg

SEQ ID NO: 408752 - DNA, 585 bp, Homo sapiens
  misc_feature: GZ8MTXP01B9F7O.3.82.H05.1.454.CMB.2.raw
  modified_base (403)..(403): a, c, t, g, unknown or other
  modified_base (437)..(437): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgagggggaaggggctgggagtgggtctcgagtttacttacattctggtaccaactactctacctcccgaccccgtgaacgggccaattaaacccntcctaccagacgacgattacccgagaacacggtntatcttacaaattcggaaactaccgtgacgacgacccgaacgacctacggtccgtttaattacgtggtgcgtaagacgtattcggaaggttcggggttaccgggaccttccaaccgttgggttctacgttcgacttcgttcgtcgggg

SEQ ID NO: 408753 - DNA, 590 bp, Homo sapiens
  misc_feature: GZ8MTXP01BWCAO.3.82.H05.1.454.CMB.2.raw
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttggtcggggcgacttcggtacggtttttaaacaggtagttgggtttagtcgttgggtatcagacaaaggaaaaccgaaggggaaacgcccctaggacgtttcctgatgtctgctgcactcccaccctgacaaaggtggactcccatccagattcagcgtcaagtgaatcgtagggacagtagttcactctacaccatcagcagcctagcagcctagaatattttagacttaaactttactattacgtacaaacgtggacttagacctacgttcccctcccgcttccgtacggtttccggggacgggaacgggtaaccgaaggggttggaagttactaacggaaaccgtaacgttggcggttactcggttaacctaaccg

SEQ ID NO: 408754 - DNA, 680 bp, Homo sapiens
  misc_feature: GZ8MTXP01DDVUW.3.82.H05.1.454.CMB.2.raw
  modified_base (510)..(510): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcgtggtttctgtgctattcaaaggtgtcagtgtgaggtgcgaggtggtggagagtgggaggagcttgatccgagccgtgggggtcctgagactctctgtgcacgcctgtggtcttcgaccgtcagtagcagctacatcgccacgttcgggcccgccgacggtccgtaccggaagggggtaacggggcgtaggggaggttcgggtactacgtaagttttaactttaactaatttcgtacggtaaccctaaataacttaacctaccgtacccggaaccccggttaggaaaccggggtcctaaacttaaacccattcccaccgaagggaacaaccgtacgttacccggaaagtaaaccgtacgggttnttaactaccttaaacaaactacggaaactaacgtaggaacgacgaccgtaacgacgtaaccgttcttaatacgtgtacgaagtaagttagtacgttacggtagggttcgggttacccggccttccgttaaccggttgttaaccttacgtcgttacgtcgttcgggtcggg

SEQ ID NO: 408755 - DNA, 576 bp, Homo sapiens
  misc_feature: GZ8MTXP01D5BUY.3.82.H05.1.454.CMB.2.raw
  modified_base (395)..(395): a, c, t, g, unknown or other
  modified_base (496)..(496): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgagggaggggctgggagtgggtctctagttatttacaacttctaggtaccacactaactactcccgacccgtgaacgggccattaaccntctaccagagacgattccgagaacacggtgtatcttacaaatgaaacaacgtgagacgaccgacgacaccggtccgtttaattacgtgtcgcgaggaagtnttcggaggttcgggttaccggggccttcgacccgttggttaaccttacgttcgtactccgttcgtcggggttccgtcggg

SEQ ID NO: 408756 - DNA, 574 bp, Homo sapiens
  misc_feature: GZ8MTXP01A28N6.3.82.H05.1.454.CMB.2.raw
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttggtcgggcgactcgtcggttttaacagtatggttagtctggtatcagcaagaaaccgagggaaacgcccctgagttcctgatgtctgctgcactcccaccctgacaagtggactcccatccagcttcagtcgtcaagttgaaacttcgtaggggactaggtacgttccacttctacaccatccagacacggccctaggccacgtcctaagtacgttattttacgactttaaacctttacttaatttcgacgtaacgaggtcctaggaactcgttccctcccgtacttccgttacggttccgggacgggtaacgggacgagggttcgaagactaacgaaacgtagttggtcgcgtaacg

SEQ ID NO: 408757 - DNA, 867 bp, Homo sapiens
  misc_feature: GZ8MTXP01BC6M3.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccgagccgtgggggtcctgagctctcctgtgcacgcctcgtggcttcaccgtcagtagcagctacatgcacgtggggtcccgaccgacgggctacccggaaggggggaacgggggtcctagggggtaacggttcgggggttaccttacgtaaggttttaactttaaccgtaaactttccgtaggttaacccaactacgttaaaacccttaccgtccccggaaaccccggttagggaaacgggtaccccgtaaattaaaccccagttaccctacccgaaggaacggtaaccgtaacgtttacccggaaacgtaaaccggtaaccgggtttaggttaaacctttccgttaaaacctaaaaacgttacgggtaaaaacccctaaaccggtacgggaaacggtaaccgaccccgggaaacgtacccggaaacggtttaccccgttttaaagttacccggtagggttacggaaccggtaaggtaaacggttaacgtttccgggggtaaacggtttccggggggtttaccccgggggtaaaccccgttccgtttaaacccccgggtttcgggtttttaaccccgttaacccggtttccgttaaacgttcccgggtttaccggggtttccggggggccccggttttccccggggg

SEQ ID NO: 408758 - DNA, 612 bp, Homo sapiens
  misc_feature: GZ8MTXP01C1RNI.3.82.H05.1.454.CMB.2.raw
  modified_base (362)..(362): a, c, t, g, unknown or other
  modified_base (430)..(430): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtgggtccgccaggctccgagggggaagggctgggagtggggtctctagttatttacaatttctaggtaccanataactactccgacccgtgaacgggcattaaccatctaccagacgacgattaccgaagaacacgggtntactcttacaaatagaaacaaccgtagaacgagaccgaacgaccacggtaccgtttaattaccgtagtgacgaaggtaacgtaagtttccggaagggttcgggtttaccgggggaacccttccgttacccggttcggttcttaaccgttcgtaacgtcgttccggtcgggggcccgttcggg

SEQ ID NO: 408759 - DNA, 593 bp, Homo sapiens
  misc_feature: GZ8MTXP01EKW99.3.82.H05.1.454.CMB.2.raw
  modified_base (299)..(299): a, c, t, g, unknown or other
  modified_base (364)..(364): a, c, t, g, unknown or other
  modified_base (503)..(503): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcgtgggttttccttgttgctatttcaaaaggtgtcagtgtgaggtgcaggtggtggagacgtggaggaggcttgatccagccgtgggggtccctgagactctcctgtgcagcctctggcttcaccgtcagtagcagctacatgcacgtcgggtccnccgaggcctaccgaagggggaaggggctgggagtgggtctctagttattacaattctggtaccanataactactcccgacccgtgaacgggcattaacatctcagagacgattccgaagtaacacgtatgtatacttaacaaatcgaaacaactgaagacgacccgaacgaccgacggttaccgtttatacgtgtagcgtaagngttagttcggaaggttcggggttcccggggaaccttccgaccccgtttgggttacctaacgtttcgacgttccgtcgttcgggggtcccg

SEQ ID NO: 408760 - DNA, 600 bp, Homo sapiens
  misc_feature: GZ8MTXP01EOS7F.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatcgcacgtgggtccgccgaggctccgaagggggaaggggcgtgggagtgggtcttacgtagttattacaacttcgtggtaccactactaacctacctcccgaccccgtaggaacgggcctacttaaccatactaccaggacgacgacttcccggaaagtaaaccgtacgggttatactcttaacgaaatacgaaaccacggtagaagacgcccgaacgacacgggtcctttaatacgtgtcgcgagaagtagttcggaggttgggttccgggaccttccgaccgttggtcctattcgattcgcgtggggccgtcgg

SEQ ID NO: 408761 - DNA, 730 bp, Homo sapiens
  misc_feature: GZ8MTXP01AN9AV.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgcttatttacaaaaggtgtccagtgtgaggtgcgaggtggtggagacgtggaggaggcttgatccgagccgtgggggtccctgagctctcctgtgcacgtcctcgtggtcttcaccgtcagtacgcagctacatcgctacgtcgggtcccgccgaggccgtaccggagggggaacgggggcgtggggaggttcgggtcttacgtaagtttaacttttaactaacgtttcgtacggtaaccctaactaacttaaacccgtacccgtccccggaaccccgggtagggaaaccgggtacccgtaaactttaaacccgacttacccgtaccgaagtaacgaaccgtacgttaccccggaaagtaacccgtacgggttataacttaccttaaacgaaaacttacgaaacctaaccggtggaacgacgacccgaacgtacgtaccggttacgttttactacgtggtacgacggtagaagttacgttcgggacgggttcggggttacccggccttaccgttcccgttggttaaccttacgttccgtacgttcccgttcgggtcggggttcccgtcgg

SEQ ID NO: 408762 - DNA, 612 bp, Homo sapiens
  misc_feature: GZ8MTXP01D6GGN.3.82.H05.1.454.CMB.2.raw
  modified_base (477)..(477): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacgttggtcgggcgacttcggtacggttttaaacagtagttggttagtcttggtatcgagacaagaaaccgagggaaacgcccctgacgttcctgtatgtctgctgcactccaccctgacaagtgactccatccagtacttcagtcgtcgaaagtagaacgtcgtagggaactagtacgttacacttaccacaaccatcacgacacgccgtgcacggcctagtaacgttatttacgaccttaaactttacttaattacgtacaaaccgngtctacgactaccgttccctcccgtcgttaaccgtacggtttcggggaccgggttaacggggaaaccgtaaggggttacggaacgttaactaaccggaaaacgtcgtcgggtacggttccgttaacgcccgtaac

SEQ ID NO: 408763 - DNA, 602 bp, Homo sapiens
  misc_feature: GZ8MTXP01EJVM3.3.82.H05.1.454.CMB.2.raw
  modified_base (283)..(283): a, c, t, g, unknown or other
  modified_base (298)..(298): a, c, t, g, unknown or other
  modified_base (432)..(432): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccgagccgtgggggtccctgagactctctgtgcagcctcgtggcttcacgtcagtagcagctanatgcactcgggtccnccgaggccgtaccgaagggggaacgggggcgtagggaggtggggtcttactaggtttatttactaacttcgtaggtaccactactaacctacctcccgacccgtagaacgggccgtattaaccatcctccaganacgtacttccgaagaacgacgtagtatacttacaaatacgaaaccaacgtgacgacgaccgacgaccgcgtccgtttataccgtgtgacgagaacgtgttcggaggttcgggtacgggtcccttcgacccgttggttctacgttcgactcgttcgtcggggttccgtcgg

SEQ ID NO: 408764 - DNA, 626 bp, Homo sapiens
  misc_feature: GZ8MTXP01CDIPX.3.82.H05.1.454.CMB.2.raw
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttggtcgggcgactcgtcggttttaacagtatggttagtctggtatcagcagaaaccgagggaaacgcccctgacgttcctgatgtctgctgcactcccaccctgacaaaggtggacgtccccatccacgtacttcgagtcgtcaaggttgaacttcgtaggggactaggtacgttaccactcctaccacctataccgacgccacgccctgaccgacggtcccgttagtaaaggttactttttacgaccttaaactttacttattacgtaccaaacgtacggtctacgtacctacggttccctcccgtccttccgtaacggtttccggggaccgggacggggtaaccgtaagggttacgggttaagacgtaaccgaaaacggtaaccgttgggtcggttactcggttaacctaaccg

SEQ ID NO: 408765 - DNA, 587 bp, Homo sapiens
  misc_feature: GZ8MTXP01E3OEB.3.82.H05.1.454.CMB.2.raw
  modified_base (368)..(368): a, c, t, g, unknown or other
  modified_base (437)..(437): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccgcccagggcctccggaagggggaacgggggctgggagtggggtctcgtaagtttattacacttctgtaccanataacctactcccgacccgtgaacgggccattaaccatctccagacgacgattaccgaagaacacggtntaactcttacaaatcgaacaaccgtgaagacgccgaacgacacggtccgtttatacgtgtgcgagaacgtattcggaggttcgggtccgggaccttccgttacccgttggttcctacgttcgactccgttcggttcgggggccgtccggg

SEQ ID NO: 408766 - DNA, 574 bp, Homo sapiens
  misc_feature: GZ8MTXP01DVP76.3.82.H05.1.454.CMB.2.raw
  modified_base (279)..(279): a, c, t, g, unknown or other
  modified_base (293)..(293): a, c, t, g, unknown or other
  modified_base (351)..(351): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgtcggttttaacagtatggttagtctggtatcagcaagaaaccagggaaacncccctgacgttccngatgtctgctgcactcccacctgacaaagtggactcccatccagattcagctcaagtnaatcgtgggacaggagttcacttctacaccatacagcacggtcctgaccacgtcctagtaaagttattttacgacttaaactttacttattacgtacaacgaggtctagacctacggttccctaacccggtcttccttacggtttccgggacggggtaacggaaccgttaagggttgggaactaacgtaacgaaaacggtacgttacggtcgggttctaaccg

SEQ ID NO: 408767 - DNA, 715 bp, Homo sapiens
  misc_feature: GZ8MTXP01AXLCS.3.82.H05.1.454.CMB.2.raw
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttgtcgggcgactcgtacggttttaacagtatggttagtctggtatcagacaagaaaccgaggaacgcccctgagttcctgatgtctgctgcatcccacctgacaaaggtcgacgtccactaccagtacttcgacgtaccgttacaaggttagaaacgttcggtaagggggaactaggtacggtttaccaccttacctaccaacctatccaagccacggtccctaggacctacgtaccgtaagttaaacggttacgtttttacggaacccttaaaccttttaccttaagtttacggtaaccctaaacgggtacgttaccgttacggtaaacccttccgggttaccccttcccccggtacgttacccgttaaacccggggttttcccgggggaaccgggggtaaaccgggggttaaccccggttaaaggggggttcgggaaaacggtaccgttaaacccgggaaaacggtaacccggttgggtaaccggggttcctaaccgg

SEQ ID NO: 408768 - DNA, 681 bp, Homo sapiens
  misc_feature: GZ8MTXP01CJ8PS.3.82.H05.1.454.CMB.2.raw
  modified_base (284)..(284): a, c, t, g, unknown or other
  modified_base (297)..(297): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttggtcgggcgacttcggtacggttttaacagtagtggttagtctggtatcagacagaaaccagggaacncccctgagttccngatgtctgctgcactcccacctgacaaagtggactccatccgagtatcagtccgtacaaggtgtaaactccggtaggggaactacggtacgtttaccaacttcctacctaaccataccgagacgaacggtcccttaggaccgtaacgtacccgttaaggtaaacggtttaacgtttttacggtaaacctttaaacttttaaccttaacgttttaccggtaaccaaaacggtacgggtacttaaccgggtaaccttaccgttccccgttcccccggttctttacccggttaccggttttaccggggaaccggggtaaacggggaacccgttaaggggttacggaacggtaacttaaccgaaacgtacgttggtaacgcgtaaccg

SEQ ID NO: 408769 - DNA, 697 bp, Homo sapiens
  misc_feature: GZ8MTXP01AKA14.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgcgaggtggtggagacgtggaggaggcttgatccgagccgtgggggtccctgagactctccgtgtgcacgtcctcgtcggtcttcacccgtcagtagcagctacatcgcacgtcgggtcccgccgaggccgtaccggaagggggaacggggcgtgggaggttcggggtctacgtaagtttactttaacgtaacttcgtacggtaaccaacgtacttaaaccctacccgtcccgggtaaccccggttagggtaaaccggggttacctaaactttaaaccccgacgttacccgtacccgaaaggaccggtaaccgtaacgtttacccggaaagtaaaccgtacgggttataacttacgtaacaaaagtccgaaacacgtagaacgaccgaccgaacgacgtaccgtctttaatacgtgtcgacgtagaagtcgttcggaggttcgggtaccggaccttcgttaccgttggttcctacgttcgtgttcgttcgggtcgggttccgtccgg

SEQ ID NO: 408770 - DNA, 721 bp, Homo sapiens
  misc_feature: GZ8MTXP01CG3KJ.3.82.H05.1.454.CMB.2.raw
  modified_base (270)..(270): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcacgcctctggcttcaccgtnagtagcagctacatgcacgtgggtccgcaggctccgagggagggctgggagtgggtctcgtagttatttacaactttctggtaccacataacctacctccgacccgtagaacgggccaacttaaccatcctccagtacgacgtacgttccgaagaaaccgtacggtgttaactaccttacaaaagttcgaaaccaaccgttggaacggaacgaccccgtaacggaacccgtaaccgggttaccccgtttttaaagtaccgttacggttacggaccggaaggtaaggtaacgttttacccggggaaagggttttccgggggtttacccgggggaaccccgtttacccgttaaacccccggttttggggttttaacccctttaaaccgtttttcccgggtaaacgtttccccggtttaccgggttccgggggggttccccggtttcccggggg

SEQ ID NO: 408771 - DNA, 718 bp, Homo sapiens
  misc_feature: GZ8MTXP01DOFPV.3.82.H05.1.454.CMB.2.raw
  modified_base (297)..(297): a, c, t, g, unknown or other
  modified_base (413)..(413): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccnccgaggctccgagggggaagggggctgggagtcgggtctcgtagtttacttacaattcgtaggtacccaaactataacctacctcccgaccccgtgaacgggccgtattaaacccngtctaccagacgacgattcccggaagtaaaccgcggttaggtaacttcctttaacaaaagttcggggaaaacctaaacccgtgggaaacggaacgccccggaaacggaaccgtaaccgggttcccgttttaagttaaccgtgggttacgggaaccggaaaggagggttaacgtttaccgggtaaacgggggtttacgggggtttaccccggggggaaccccttacccggtaaccccggtttcgggggtttaaccctttaacccgtttcggggaacttttcccggttcggggtttcccgggggggg

SEQ ID NO: 408772 - DNA, 532 bp, Homo sapiens
  misc_feature: GZ8MTXP01DNBH3.3.82.H05.1.454.CMB.2.raw
  modified_base (349)..(349): a, c, t, g, unknown or other
  modified_base (412)..(412): a, c, t, g, unknown or other
  modified_base (470)..(470): a, c, t, g, unknown or other
tcagagacgcactccacgaccggtgctcgatttagtcgagctctctcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactgggtccgcaggctccgaggggagggctggagtgggtctcagttattacaattctggtaccanataactactccgacccgtgaagggccattaaccatctcagagacgattccgagaaacacggtntatcttacaaatgaacaacgtgagagccgacgacgcgcctttatactgtgcgagaagnttcgagttgggttcgggccttcgacccttggttctacttcgactcttcgtcggggccgtcgg

SEQ ID NO: 408773 - DNA, 804 bp, Homo sapiens
  misc_feature: GZ8MTXP01BIM1Y.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtcccgccgaggccgtaccggagggggaacgggggcgtgggaggtgggtctcgtagtttactttactaattcgtacggtacccaaacgtaacttaaccgttacccgtaccccggtaaccccggttacgggaaaccggggtaccccggtaaactttaaaccccacttacccgttaccgaacggaacggtaaccggtaacgtttaaccccgggaaacgtaaaaccgtaaccgggttacggttaaacttacctttaaaccgaaaacttaaccgggggaaaaccctaaacccggttacggaaacgggaaaccggaccccgaaccgggtaaccgtaaacccggggttacccgtttttaaacgttaaccgttgggtacggtaaccgggtaagttagggtaacgtttacgggtaacgggtttcgggggttacccgggggttacccttacccggtaacccggtttcgggttaaccttaccgttacggttacgtttcccggttcggggttcccggggg

SEQ ID NO: 408774 - DNA, 576 bp, Homo sapiens
  misc_feature: GZ8MTXP01DL7XY.3.82.H05.1.454.CMB.2.raw
  modified_base (300)..(300): a, c, t, g, unknown or other
  modified_base (357)..(357): a, c, t, g, unknown or other
  modified_base (405)..(405): a, c, t, g, unknown or other
  modified_base (430)..(430): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccagccgtgggggtccctgagactctcctgtgcagcctctggcttcaccgtcagtagcagctacatgcacgtgggtcccncgaggcctaccgagggggaaggggctgggagtggggtctcgtagttattacaattcnggtaaccacataacctactcccgacccgtgaacgggccattaacatcncagagacgatccgaagaacacggtntatcttacaaatgaaacaccgtgaacgagccgaacgacacggtccttttaataccgtgtagcgaagaagtattcggaggttcggttccggggaccttcgttaccttggtttctacgtttcgacttcgttcggtcggggccgtaacg

SEQ ID NO: 408775 - DNA, 597 bp, Homo sapiens
  misc_feature: GZ8MTXP01EYR66.3.82.H05.1.454.CMB.2.raw
  modified_base (356)..(356): a, c, t, g, unknown or other
  modified_base (430)..(430): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgaggggaggggctgggagtgggtctcagttattacaattctaggtaccanactaacctactcccgacccgtgaacgggccgtattaaccatcctccagacgacgattccgaagaacacgggttntactacttacaaatcgaaaccaaccgtgaagacgacccgaacgaccgacggtacttttatacgtgtcgcgagaagtgttcggaggttcggggttaccggggaccttccgttcccgttcgggtttctaccgtttcggtacttcgttcggtcgggggttcccgtccggg

SEQ ID NO: 408776 - DNA, 640 bp, Homo sapiens
  misc_feature: GZ8MTXP01DRV1B.3.82.H05.1.454.CMB.2.raw
  modified_base (251)..(251): a, c, t, g, unknown or other
  modified_base (443)..(443): a, c, t, g, unknown or other
  modified_base (451)..(451): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagactggaggaggcttgatccagccgtgggggtccctgagactctcctgtncagcctctggcttcaccgtcagtagcagctacatcgcacgtcgggtccgccgaggctccggagggggacgggggctgggagttgggtctcgtagtttacttacaattctaggtacccaactactaactactcccgaaccccgtgaacgggctaattaacccatctccagacgacgtataccgagacacggtntactctanaaataggaaacacgtgacgacgcccgacgacgaccgggttcctttaagttaccgtaggttcggaacgtaagggttaagttacggtttacgggtaacggggtttcggggtttacccgggggacccttacccggtaaccccgtttggggtttcccttaccgttcgacgtttccgttccgggttccgggggg

SEQ ID NO: 408777 - DNA, 717 bp, Homo sapiens
  misc_feature: GZ8MTXP01BLKU8.3.82.H05.1.454.CMB.2.raw
  modified_base (257)..(257): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctntggcttcaccgtcagtagcagctacatcgcacgtcgggtcccgccaggcctaccgaagggggaacgggggctgggaggttgggtctacgtagttattactaattctaggtaccactactaacctactcccgacccgtggaacgggccctattaaccatcctaccgaagacgaacgtacgttacccggaaagtaaacccgtaggggttacttaacttacccttaacaaaaagttacggaaaaccctaacccggttaggaacggaaccggaccccggaaaccgtaaccgacccggggtttacccgttttaaagttaccgtggttacggccggaagggtaacgtacgtttaccgggaagggtttcgggggttaccccgggggtaacccttcccggaccccgtttggggtttcccttacgtttccgggacttcccggttcgggtcggggggttcccgttccggg

SEQ ID NO: 408778 - DNA, 550 bp, Homo sapiens
  misc_feature: GZ8MTXP01C0S05.3.82.H05.1.454.CMB.2.raw
  modified_base (283)..(283): a, c, t, g, unknown or other
  modified_base (319)..(319): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctcgtgtctgcatcgtggtaggggacagagtcgctatgacttggcgggcgacgtcgtcggttttaacagtattggttagtctggtatcagacaagaaaccgagggaacncccctagagttcctgatgtctgctgcactcccaccngacaaaggtgacgtccactccagtattcgagtcgtcaagtagaattcggtagggaacaggtactccacttcacacagtcagacacgcctgacacgtactagtaacgttatttacgaacttaaacttactattcgactaacgaggtctagactcgtcctccgcttcggtacgttcgggacggaacggacgagggttcgaagtactaacgaaacgtcgttaggtcgctaaccg

SEQ ID NO: 408779 - DNA, 558 bp, Homo sapiens
  misc_feature: GZ8MTXP01C9AJ5.3.82.H05.1.454.CMB.2.raw
  modified_base (294)..(294): a, c, t, g, unknown or other
  modified_base (500)..(500): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccnccaggctccgagggagggggctgggagtgggtctcgtagttatttacaattctggtaccacataactacctccgaccccgtggaacgggccgattaaccatcctaccagagacgtacttccgagaaacacggtagtatctacaaatagaaaccaacgtgacgagcccgacgaaccacggtccgtttaattctgtgcgtagaacgtnttcgaggttggtccggggcttcgcccttggttctactgtatcgttcgtcgggcgtcgg

SEQ ID NO: 408780 - DNA, 760 bp, Homo sapiens
  misc_feature: GZ8MTXP01BZC3Z.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtgggaggaggtcttgactccgacggtccggtcgggggtccctggacgtacctctccgtggtcgcacgtcctcgtcggtcttccgacccgtcaggtagcagtactacatcgcctacgtcgggtcccgccgacggtccgtaccggaagggggaacggggtcgtagggtaggttcgggttctacgttaagtttatttaactaactttcgtacgtaccacgtacttaaacctacccgtcccggaacccggtagggaaaccgggtacccgtaacttaacccacgtccctaccgaagacgaacgtacgttaccggaaagtaaccgtcgggttatacttactaaacaaagttacgaaacctacggtaggaacggaccgacccggaaccgtaccgtaccgggttaccttttaaagtcgtgtacgacggtaagtaacggttattccggggtagggtttccggggttaaccccggggtacccttacccggttaccccggtttgggttttaaccccttaccgttcggtccgttccggttcgggttccggggggttccgttccccggg

SEQ ID NO: 408781 - DNA, 629 bp, Homo sapiens
  misc_feature: GZ8MTXP01EBW7L.3.82.H05.1.454.CMB.2.raw
  modified_base (480)..(480): a, c, t, g, unknown or other
  modified_base (486)..(486): a, c, t, g, unknown or other
  modified_base (607)..(607): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtgggaggaggcttgatccgaggccgtgggggtcctgagactctcctgtgcagcctcgtggcttcaccgtcagtagcagctacatgcacgtcgggtcccgccgaggccgtaccggaagggggaacggggctgggaggtcgggtctacgtagtttaattactaattcctaggtaccactactaaccctacctcccggacccgtaggaaaccgggtacctaacttaaccattcctaccgaagtaacgacgtacgttccgaaagaaaccgtacggttntaactntaaccaaatacgaaaccacggtgaagcgaccgaacgacgtaccggttctttaataccgtgtagcggaggtaatgttcggaggttcgggtaccggtaccttcccgttcgttggttctacgtnatcgttcggtcggggctccggg

SEQ ID NO: 408782 - DNA, 570 bp, Homo sapiens
  misc_feature: GZ8MTXP01BP918.3.82.H05.1.454.CMB.2.raw
  modified_base (246)..(246): a, c, t, g, unknown or other
  modified_base (271)..(271): a, c, t, g, unknown or other
  modified_base (316)..(316): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcgtggtttcgtgtaggctattacaaaaggtgtcagtgtgaggtgcaggtggtggagatggaggaggcttgatccagccgtgggggtcctgagctctcctgtgcncgctcgtcgtctcacgtcagagcanactacatgcgacgtcggtccgcgcgcgacggagggagggcgtggngtggtcgtagtagttattactactctacgtactactactaactaccgtccgaccgtacgacggtacgtactaactactactacagacgacgtacgtacgaacgaacgtacgtacgtactactactaactaacaacgaacgacgacgacgacgacgacgtacgtacgttactacgtgtgcgagaagtagttgtcggttcggtcggtcgttccgttcgttcgttcttcgtcgtcgtcgttcggtcgggttcggtcg

SEQ ID NO: 408783 - DNA, 575 bp, Homo sapiens
  misc_feature: GZ8MTXP01DJOK8.3.82.H05.1.454.CMB.2.raw
  modified_base (349)..(349): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttggtcgggcgactcgtacggttttaacagtatggttagtctggtatcagacaagaaaccgagggaaacgcccctgacgttcctgatgtctgctgcactcccacctgacaaagtgactccatccagatcagcgtnaagtgaatcgtagggacaggtacttccactctaccacatcgacgcaacgcctagcctagcctagaaagttattttacgacttaaactttaactatttacgactaaagacggtctagacctacgtccctcccgtcttcgttaccgtttcggggacgggtaacgggaaccgttaaggggttgaacggtaattaaccgaaaacggtacgttcgggtcggttccgtaacg

SEQ ID NO: 408784 - DNA, 696 bp, Homo sapiens
  misc_feature: GZ8MTXP01EJ5MN.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagactggaggaggcttgatccagccgtgggggtccctgagactctcctgtgcagcctctggcttcaccgtcagtagcagctacatgcacgtcgggtccgccaggctccgagggggaaggggctgggagttgggtctacgtagtttactttacgtaatttcgtacggtaacccaaactaactaaccgttaccgtaccccggaacccccggttagggaaacggggtcccgtaaactttaaacccattcctacccgaaggaacgtaaccggtaactttaccccggaaagtaaaccaccggggttataacttacctttaaaccaaaagttacgggaaaacctaaacccgttggaacgacgaccccgaacgaccgtaccgggttcctttataccgtgtggaacgtagaggtatttcggaaggttcggggttcccggggcccttccgtaaccccgttgggttcccttaacggttcgttacttccgttcgggtccggggg

SEQ ID NO: 408785 - DNA, 625 bp, Homo sapiens
  misc_feature: GZ8MTXP01DL5Y1.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtcccgccaggcctccgagggggaagggggctgggaggtgggtctcgtagttatttacaattctaggtaccacataacctactccgaccccgtgaacgggccattaaccatcctccagacgacgtattccgaagaaaccgagggtatactcttacaaatagaaacaaccgtgacgacgacccgaacgtaccgacgggtaccttttaagtaccgtgtcgacgaaggtaagtaattccggaagggttcgggttaccgggggaacccttccggaccctttcggggtttaacctaaccgtttcggaacttccgttcgggttcgggggccgttccggg

SEQ ID NO: 408786 - DNA, 610 bp, Homo sapiens
  misc_feature: GZ8MTXP01EP24I.3.82.H05.1.454.CMB.2.raw
  modified_base (551)..(551): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctattcaaaaggtgtccagtgtgaggtgcaggtggtggagacgtggaggaggcttgatccagccgtgggggtccctgagactctcctgtgcagcctctggcttcgaccgtcagtagcagctacatgcacgtgggtcccgccgaggctccggagggggaggggctgggagtgggtctcgtagttattacaacttctaggtaccactactaaacctacctcccgaccccgtggaaacgggccgtaacttaaccgatcctaccaggtaacgacgtacttacccggaagtaaacctacggggttattaactacgttaacaaaagttcgaaaccctaaccgtggaacgacgcccgaacgaccgacgggtcccttttaataccgtgtcgcgagaagtnttcggagttcgggtcgggacttcgccttggttcactcgatcgttcggtcggggccgtcg

SEQ ID NO: 408787 - DNA, 645 bp, Homo sapiens
  misc_feature: GZ8MTXP01ES8ZI.3.82.H05.1.454.CMB.2.raw
  modified_base (478)..(478): a, c, t, g, unknown or other
  modified_base (564)..(564): a, c, t, g, unknown or other
  modified_base (569)..(569): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgcttattcaaaaggtgtccagtgtgaggtgcaggtggtggagactggaggaggcttgatccagccgtgggggtccctgagactctcctgtgcagccgctggcttcaccgtcagtagcagctacatcgcacgtcggtccgccaggccgtccggagggggaacggggctgggaggttgggtctacgtaagtttacttaactaaattcgtagtaacccaaactactaacctaccgtacccgaccccgtagaaacggggtccaacttaaacccattcaccaagacgaacgtaacgttacccgaagtaaaccgtacgggtnttaacttacttaaacaaattacgggaaacaaaccgtagaacggaacgacccggaacgaacgtaccggtaccgtttaattacgttgnggaanaaggagtagttcgtaagggttcggttaccgggccttccgaaccgttggttctacgttcgacttcgttcggtcgggg

SEQ ID NO: 408788 - DNA, 722 bp, Homo sapiens
  misc_feature: GZ8MTXP01CR13K.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccgagccgtgggggtccctgagactctcctgtgcagcctctcggtcttcgaccgtcagtagcagctacatcgctacgtcgggtcccgccgacggccgtaccggaagggggaacggggtcgtagggtaggtcgggtctacgttaagtttatttaactaactttcgtacggtaccaactacttaaacccttacccgtcccggtacccggtagggaaaccgggtaccgtaacttaaccgactaccctaccgaacgaacggaacgtacgttaccgaacgtaacgtacggtacgtacttacgttaactaaactacgaaacctaacggtacgaacggaccgaccgaacgaccgtaccggttaccgtttaacgttaccgtagtacggggggacaggtaagtacggttcggtaacgggttcggggttacccgggtacccgttacccgttacccgttcggttaaccgttacgttcgtacgttccggttcggtccggggttccggttcccggg

SEQ ID NO: 408789 - DNA, 741 bp, Homo sapiens
  misc_feature: GZ8MTXP01DY83L.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggtttttccttgttgctatttcaaaaggtgtccagtgtgaggtgcaggtggtggagactggaggaggcttgatccagccgtgggggtccctgagactctcctgtgcacgcctcgtggcttcaccgtcagtagcagctacatgcacgtcgggtcccgccgaggcctaccggaagggggaagggggcgtgggaggtcgggtctcgtaagtttatttactaacgttcgtacggtacccactacttaaccctacctcccggaccccgtagggaaaccggggaccctaacgttaacccattacctacccgaaggaacgaccgtacttacccggaaagtaaaccgtacgggttataacttaccttaacaaaattacgaaacctaaccggtaggaacggaacggaccccggaaacgaaccgtaaccgggttacccgttttaaagttaccgttggttacggaccggaaagggtaagttacggtttaccgggtaacggggtttccggggttacccgggggtaaccctttacccgttaccccggtttgggtttaacccttacgtttccggactttccggttccgggttcgggggcccgttccggg

SEQ ID NO: 408790 - DNA, 564 bp, Homo sapiens
  misc_feature: GZ8MTXP01D2SG3.3.82.H05.1.454.CMB.2.raw
  modified_base (209)..(209): a, c, t, g, unknown or other
  modified_base (214)..(214): a, c, t, g, unknown or other
  modified_base (219)..(219): a, c, t, g, unknown or other
  modified_base (246)..(246): a, c, t, g, unknown or other
  modified_base (260)..(260): a, c, t, g, unknown or other
  modified_base (266)..(266): a, c, t, g, unknown or other
  modified_base (268)..(269): a, c, t, g, unknown or other
  modified_base (274)..(275): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcgtggtttcgtgtaggctattacaaaaggtgtcagtgtgaggtgcaggtggtggagactggagggngctgntccgngcggtggggtcctgatctctctgcgcncgctcgtcgtctcnctcagncnnctacnngcgcgtcggccgcgcggcgcggagggagggtgtggtggtggtcgtctagttattactactacgtacgtactactactaactaccgtccgtaccggtacgacggtacgtactactactactacagacgacgtacgtacgtaacgaacgtacgtagtactactaactaactaacaacacgacgagacgacgacgacgtacgtacgttagtgtgtagcgagtaagtgttcgtcggttcggtcggtccgttccgttcgttcgttctcgtcgtcgtcgttcggtcggttcgtcg

SEQ ID NO: 408791 - DNA, 632 bp, Homo sapiens
  misc_feature: GZ8MTXP01DIMC0.3.82.H05.1.454.CMB.2.raw
  modified_base (368)..(368): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctcgtggcttcaccgtcagtagcagctacatgcacgtgggtcccgccaggcctccggagggggaaggggcgtgggaggtgggtctctagtttattacaacttcgtagtaccanataacctactcccgacccgtagaacgggccgtaattaaccatcctaccagacgaacgtacttacccgaagaaacgtacgggtatactacttaacaaatcgaaacaaccgtgaacgacgaccgaacgacgtaccggtactttaataccgtggtacgacggagtaacgtagttcggtacgggttggggttaccggggacccttcggttacccttcgggtttaacttacgttcgtacgtccgttcggtcgggggttcccgtaacggg

SEQ ID NO: 408792 - DNA, 652 bp, Homo sapiens
  misc_feature: GZ8MTXP01DXH9I.3.82.H05.1.454.CMB.2.raw
tcagagacgcactccacgaccggtgctcgatttagtcgagctctctcgcggggggtagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtcctgagactctcctgtgcacgcctctggcttcaccgtcagtagcagctacatgcacgtcgggtccgccgaggcctccgaaggggaggggcgtgggagtgggtctcgtagttatttacgaattcgtaggtaccactactaacctaccttcccggaccccgtaggaaacgggtcccgtaacttaacccatacctacccgaaggacgacgtacgttaccgaagtaaaaccgtcgggttataactcttaaaccaaagttacgaaaccaaccggtaggacggaacgacccgaacgaccgtacggtacgtttaattaccgtgtcgacgagaagtagttcggagggtttcgggtaccggggacccttcgttacccgttcgggtttaactacgttccgtatccgttcgttcgggggcccttaaccggg

SEQ ID NO: 408793 - DNA, 588 bp, Homo sapiens
  misc_feature: GZ8MTXP01BH6FB.3.82.H05.1.454.CMB.2.raw
  modified_base (364)..(364): a, c, t, g, unknown or other
  modified_base (438)..(438): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtgggtccgccaggctccgaggggaaggggctgggagtgggtctcgtagttatttacaactttcgtaggtacccanactaacctacgtcccgaccccgtgaacgggccaattaaccatccaccagacgacgactccgaagaacgacggtntactcttacaaatcgaacacgtgacgacgaccgacgaccgacggtactttatacgtgtcgcgaagaagtagttcggaggttcgggttaccgggccttccgttccgttggtttaacctacttcgacttcgttcgggtcggggccgtccggg

SEQ ID NO: 408794 - DNA, 657 bp, Homo sapiens
  misc_feature: GZ8MTXP01DY2RP.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccgagccgtgggggtcctgagactctcctgtgcacgcctcgtggcttcaccgtcagtagcagctacatgcacgtgggcccgcaggcctacgaggggaggggctgggagtgggtctctagttattactaacttcgtaggtaccactactaaccctaccgtcccggacccgtagggaaacgggcctaacttaaccattcctaccgaagaacgacgtaacgttaccgaagtaaacgtacggttagtacttacttaaacaaaagttacgaaacctaaccggtaggaacggacgacccggaacgtaccgtaccggggttactttaacttacgtgtacgacgaaggtaagtacgttcgggtacggttcggggtaccggggtcccttaccgttccgtttcggttaaccttacgttcgacttcgttccgggtcggggccgttccgg

SEQ ID NO: 408795 - DNA, 606 bp, Homo sapiens
  misc_feature: GZ8MTXP01DZ4WH.3.82.H05.1.454.CMB.2.raw
  modified_base (518)..(518): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtcccgccaggcctccgaaggggagggggctgggaggtgggtctctagtttatttacaattctaggtacccactataaaccctacctcccggaccccgtaggaaacgggcccgaattaacccatcctaccagagacgattccgaagaactacggtgtactcttacaaatacgaacaaccgtagagacgccgacgaccacggtccgtttatactgtgtcgagaagtnttcggtaggttcgggttaccggggtaccttccgacccgtttgggtttaacctacgttcgtacttcgttacggtcgggggccgtccggg

SEQ ID NO: 408796 - DNA, 575 bp, Homo sapiens
  misc_feature: GZ8MTXP01DCGC4.3.82.H05.1.454.CMB.2.raw
  modified_base (277)..(277): a, c, t, g, unknown or other
  modified_base (298)..(298): a, c, t, g, unknown or other
  modified_base (497)..(497): a, c, t, g, unknown or other
  modified_base (506)..(506): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtancagctacatgcacgtggtccnccaggctccgaggggaagggctggagtgggtctcagtttacttacaatttcgtacggtaccaactataacctactcccgaccccgtagaacgggccgtaattaaccatctaccagacgacgtattccgagactacggtgtatcttacaaattcgggaaactacgtagagacgcccgacgacaacggtcgtttaatacgngtgcgaagngtaacttcggaggttggttaccggggccttcaacccgttggtccttacgtcgacttcgttcggtcgggg

SEQ ID NO: 408797 - DNA, 649 bp, Homo sapiens
  misc_feature: GZ8MTXP01ETWYW.3.82.H05.1.454.CMB.2.raw
  modified_base (274)..(274): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagctctcctgtgcagcctctggcttcaccgtcagtancagctacatgcacgtcgggccgccagggcctaccgaagggggaagggggctgggaggtgggtctctagttatttacaacttcgtagtaccatactaacctaccgtcccgtaccccgtagggaaaccgggccgtaaacgttaacacttcctacccgagacgacgacttaccggaagaaaccgtacggttacgtacttacttaactaaaacgttagaaacctaaccggtagaacggaacgaccccgaacgaaccgaccggttaccgttttaagttaacgtggtagacgaggtaacgtagttacggacgggttcggtaccggggtaccttcgttacccgttgttcctacttcgtctccgttcgtcggggttcgtccgg

SEQ ID NO: 408798 - DNA, 758 bp, Homo sapiens
  misc_feature: GZ8MTXP01D44QW.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtcctgagactctcctgtgcagcctctggcttcaccgtcagtagcagctacatgcacgtgggtcccgccagggcctaccgagggggaagggggcgtgggaggtgggtcttacgtaagtttatttaacaacttctacggtaaccactaacttaacctaccctcccggaccccgttaggaaacggggtaccccgtaatttaaacccacttaccctacccgaaggaacggaaccggtaactttacccgggaagtaaaaccgtacgggttacgttaacttaccgtttaacaaaaacttacggaaaacccaaacccggttaggaaacggtaaccgaccccggaaccgaaaccgtaaccggtacccgtttttaaataccgtggttacgacggtaaggaaggtaactttacgggtacgggtttacgggggtttacccgggggtaacccttcccggttaaccccggtttcgggtttccctttaaacccgtttcggtaacttccgggttccggttcggggggttccccgttccggggg

SEQ ID NO: 408799 - DNA, 589 bp, Homo sapiens
  misc_feature: GZ8MTXP01AIUSE.3.82.H05.1.454.CMB.2.raw
  modified_base (446)..(446): a, c, t, g, unknown or other
  modified_base (451)..(451): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtggggtcccgccgaggcctccgaagggggaacgggggctgggaggtggggtctctagtttatttacaacttctggtaccactataaacctaccgtcccgaccccgtagaacgggcccgtaattaacccatcctaccagacgacgacttcgagaacncggtntatcttacaaatgaacaacgtgagacgaccgaacgaccgacggtccgtttattacgtgtgcgagaacgattcggaggttgggtcgggaccttcgttcccttggttcctacttcgactcgttcggtcgggttccgtcgg

SEQ ID NO: 408800 - DNA, 561 bp, Homo sapiens
  misc_feature: GZ8MTXP01AWDB6.3.82.H05.1.454.CMB.2.raw
  modified_base (294)..(294): a, c, t, g, unknown or other
  modified_base (475)..(475): a, c, t, g, unknown or other
  modified_base (483)..(483): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttggtcgggcgactcgtacggttttaacagtatggttagtctggtatcagcaagaaaccgagggaacgcccctgagttccngatgtctgctgcactcccacctgacaaagtcggacgtcccatccagtatcagcgtacaagtgaaatcgtaggggactaggtacgttcacctctcaccatccaagccagtcctagcgagtcctagtaacgtatttcgacttaactttactatttcgactaacgaggtctaggaactcgtccnccccggtnttccgtacgttcgggaccgggtaaggggaccgagggttggaacgtactaacgaaacgtacgttggttaacgcgtaacg

SEQ ID NO: 408801 - DNA, 604 bp, Homo sapiens
  misc_feature: GZ8MTXP01EST60.3.82.H05.1.454.CMB.2.raw
  modified_base (372)..(372): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagactggaggaggcttgatccagccgtggggggtccctgagactctcctgtgcagcctctggcttcaccgtcagtagcagctacatgcacgtcgggtccgccgaggctccgagggggaacgggggctgggaggtgggtctcgtagtttactttacaattcgtggtacccaanactaactacctccgaccccgtgaacgggccgattaaacccatctaccagagacgattacccgaagaactacgggtatactcttacaaagttcggaaacaaccgtggaacgacgacccgaacgaacgtaccggtaccttttagtacgtggtcgaacggtagagtacgttcgaagggttcgggttccggggcttccgaacccgttggttcttacgttcgatcgttcgtcggggg

SEQ ID NO: 408802 - DNA, 685 bp, Homo sapiens
  misc_feature: GZ8MTXP01BT1ND.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtcccgccaggctccgaagggggagggggctgggaggtgggtctacgtagtttatttaactaaacttctaggtacccaactactaaacctaacctcccggaaccccgtgggaaacggggacctaattaaccatcctaccagaacggacgtaattcccggaagtaaaccgacgggttagtaacttacgttaaccaaaattacgaaaacctaaaccgtaggaaacggacgacccggaacgtaaccgacggttaccgttttaaacttaccgtggtagaccgtaaggtaaggtaagtttccggaaaggttcgggggttaccgggggaaccccttccgttaccccgtttgggttccttacgttcggacttccggttcggtcgggggttcccgttcggg

SEQ ID NO: 408803 - DNA, 735 bp, Homo sapiens
  misc_feature: GZ8MTXP01CHBFO.3.82.H05.1.454.CMB.2.raw
  modified_base (257)..(257): a, c, t, g, unknown or other
  modified_base (490)..(490): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtgggaggaggtcttgactccgacgccggtcgggggtcctgacgactctctgtncacgcctcgtcggtcttcgaccgtcagtacgacagactacagtcgacctacggtcgggtcccgccgacggccgtaccggagggggaacgggcgtagggtaggtcgggtctacgtagtttattactaacttcgtagtaccactactaacctaccgtcccgacccgtaggaaacgggccgtaactaccgacttccacgaagtacgacgtacttaccggaagtaaacgtacggttntaacttacttaaacaaaacgtacgtaaaccgtaaccggtaggaacggaccgaccgaaaccgtaccggtaaccggtttaccgttttaagttaccgtggtacgaaccgtaagggtaacttaggtttccgggtaacggggttccgggttacccgggggacccttaacccggttcccgtttacgggtttaacccttaaccgttcgtccgtttccggttcggggtcccgggggttcccgtttaacccggg

SEQ ID NO: 408804 - DNA, 657 bp, Homo sapiens
  misc_feature: GZ8MTXP01BJBP9.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgcaggtggtggagacgtggaggaggcttgatccgagccgtgggggtccctgagactctcctgtgcagcctctggcttcaccgtcagtagcagctacatcgccacgtcgggtcccgccgaggcctaccggagggggagggcgtgggaggtgggtctcgtagttattactaacttctagtaccactactaaacctacctcccgacccgtaggaaacgggccaataaccatcctacaagacgacgattaccgaagtaaccgtacgggtataacttccttaacaaaattcgaaaacctaccgtggaacgaacgacccgaaacgaccgtaccgggttaccgtttaattaccgtggtacgaccggaaggtaacgttacgttccgggtaaggttccggggttaccgggaaccccttcgttccccgttggttaaccctacgtttcgacttcgttccgggttcggggcccgtcggg

SEQ ID NO: 408805 - DNA, 598 bp, Homo sapiens
  misc_feature: GZ8MTXP01CW8PQ.3.82.H05.1.454.CMB.2.raw
  modified_base (345)..(345): a, c, t, g, unknown or other
  modified_base (360)..(360): a, c, t, g, unknown or other
  modified_base (399)..(399): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtcctccatcctccgtgtctgcatctggtaggggacagagtcgctatgacttggtcgggcgtactcgtacggttttaacagtatggttagtctggtatcagacaagaaaccgagggaaacgcccctgacgttcctgatgtctgctgcactcccaccctgacaaagtgactccatccagtntcagtcgtcaaggtnaagtcgtagggacagtacgttcactctacacatcagtancctgcacgtcctagtaaacgttacgttttaggaacccttaaagtttactagtttacgaacgaaacgtaggtacttacggaacctacggttccctccccgtcttaccgttaccggtttccgggacggggtaacgggaacccgttaaagggttcggaaacgtaacgtaacgaaacgtacgttggacggtccttggtaaccc

SEQ ID NO: 408806 - DNA, 698 bp, Homo sapiens
  misc_feature: GZ8MTXP01A4ELW.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcggtccgccaggctccgagggggaagggcgtggaggtgggtctcgagtttactttacaatttcgtaggtacccaacgtaacttaacctaccgtaccccggtaacccccgtaggaaaccggggtacccgtaaactttaaaccccattccctacccgaaggaacgtaaccgtaagtttaccccggaagtaaaccgtaccggggtagtaaacttcttaacgaaaagttacggggaaaacaacccgttaggaacgtaacgaccccgaacggtaccaaccgggtcctttaaagtaccgtaggtcgaacggtaaggagttacgttccggaaaggttcggggttacccggggttaccttccgtaacccgttgggttaaccttaacgttcggacttccgttcggttcccggggg

SEQ ID NO: 408807 - DNA, 600 bp, Homo sapiens
  misc_feature: GZ8MTXP01CRZQB.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtcgggtccgccgaggctccgagggggaagggggcgtgggaggtgggtctcgtagttatttacaacttctaggtaccactactaaacctacctcccgacccgtggaaacgggccgaataaccatcctaccgagacgacgtacttaccgagaacacggttgtactacttacaaattacgaaaccaaccggtgacgacgccgaacgaccgacggtacgtttatacgtgtagcgagaagtagttcggagttcgggttaccggggccttcgcccgttggtcctacgttcgattcgttcggtcgggttcccgtcgg

SEQ ID NO: 408808 - DNA, 520 bp, Homo sapiens
  misc_feature: GZ8MTXP01C9DWA.3.82.H05.1.454.CMB.2.raw
  modified_base (286)..(286): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcaagaaaccagggaaacgcccctgagttccngatgtctgctgcatccacctgacaagtggacgtcccatccagattcagcgtcaagtgaatcgtaggggacagtacgttcactctcacatcagcagcctgctagcctagaacgtatttcgactaactttactaattgtacaacgaggctagacctagtcctcccgtctaactacgtttcgggacggttagggaccgtaagggttcgagagtaacaaagaacttgaggctgctaac

SEQ ID NO: 408809 - DNA, 561 bp, Homo sapiens
  misc_feature: GZ8MTXP01E1KP3.3.82.H05.1.454.CMB.2.raw
  modified_base (360)..(360): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtggggggtccctgagactctcctgtgcagcctctggcttcaccgtcagtagcagctacatgcacgtgggtcccgccaggctccgagggggaaggggctgggagtgggtctcagttattacaattctggtaccanataactactcccgacccgtgaacgggccataaccatctaccagagacgattccgaagaaacgacggtatactacttacaaaatgaaacaaccgtgaagacgaccgaacgacgacggtccgtttaatcgtgtgcgagaagtattcggagttgggtcgggaccttcgacccgttggttctattcgatccttgtcgggcgtcgg

SEQ ID NO: 408810 - DNA, 689 bp, Homo sapiens
  misc_feature: GZ8MTXP01BCIOB.3.82.H05.1.454.CMB.2.raw
  modified_base (460)..(460): a, c, t, g, unknown or other
  modified_base (508)..(508): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagactggaggaggcttgatccagccgtggggggtccctagacgtctctcgtgtcgacgacgtcctcgtcggtccttccgtaccgtagagtacgcgacgtactactagtcgaccgtacggttccgggcccgaccggacggtcccgtacgggaagggggacgggtcggtagggtagggttcggtctacgttagtttacttactacttcgtacgtaccactactaacctaccgtcccgtaccgtagggaccggaccgtaactaacnctaccacgaagacgacgtactacggaagaacgtggttatactctaaanatacgaaaccctggacgagaccgtacgaacgaccggtacggttactttaatcgtggtacgacggtaaggaacgttcggttaggggtacgggtttccggggtacccggtaccttacccggttccggtttcggtttaacctacgggttctccttccgggttcggggtccgggggttcgtcccg

SEQ ID NO: 408811 - DNA, 740 bp, Homo sapiens
  misc_feature: GZ8MTXP01C9ONQ.3.82.H05.1.454.CMB.2.raw
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatcgtggtaggggacagagtcgctatgtacgttggtcgggcgtacgtcggtacggttttaacagtagttggttagtctggtatcagacaagaaaccgagggaaacgcccctgacgttcctgatgtctgctgcactcccacctgacgaaaggtcggacgtacccactacgaacgtactacgacgtacgtacgtaagttacgtaacgtacgggacgggtaaacgtacggtaccttacctaccttacctaccctaactacaccgacgaccaccggtcctacggacgtaccggtaccgttaaaggttaaacgtttaacgtttaccgtaaaccgttttaaacgtttactttaacgttaaccgtaaacgtaaaccgtacggtaccgtaaccggtacctacccgttccccgtcccgttaccgttaacccggtttaccggggttaccggggaaaccgggggttaaacgggtaaaccggggtaagggttaaacgggttaacgttaaaccggtaaaacggtaaaaccggtggtttacgggacgttaccgtaaccgaaccgttaacccg

SEQ ID NO: 408812 - DNA, 649 bp, Homo sapiens
  misc_feature: GZ8MTXP01A67ZN.3.82.H05.1.454.CMB.2.raw
  modified_base (254)..(254): a, c, t, g, unknown or other
  modified_base (567)..(567): a, c, t, g, unknown or other
tcagagacgcactccacgaccggtgctcgatttagtcgagctctctcgcggggatgggagaggagcccagcactgggattccgaggtgtttccattcggtgatcagcactgaacacagaggactcaccatggagttttggctgagcttgggttttccttgttgcttatttcaaaaggtgtccagtgtgaggtgcaggtggtggagactggaggaggcttgatccagccgtgggggtccctgagactctcctgtncagcctctggcttcaccgtcagtagcagctacatgcacgtcgggtccgccaggcctaccggagggggaacgggggctgggagttcgggtctctaagtttactttacaatttcgtaggtaacccaactacttaaccgtaccgtcccggaacccccggtaggaaccggggcccgtaaattaaacccgatcctaccgaagacgtacgagttaccccgaagtaacctacgggtattaactcttactaaaatacgggaaactaaccgtagaacgaacgcccgaacgacgtaccggtccgtttatactgtgaacgaagngtacgttcggaagttcggggttaccgggccttaccgtaacccgttagggtttctacgttcgacttccgttcggttccggggg

SEQ ID NO: 408813 - DNA, 663 bp, Homo sapiens
  misc_feature: GZ8MTXP01EIUBF.3.82.H05.1.454.CMB.2.raw
  modified_base (466)..(466): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtacaggtggtggagactggaggaggcttgatccagccgtgggggtccctgagactctcctgtgcagcctctggcttcaccgtcagtagcagctacatgcacgtgggtcccgccgaggcctccgagggggaaggggctgggagtgggtctcagtttatttacaattcgtaggtaccactaactactaaccgtcccgaccccgtaggaacgggccgtaattaaaccatcctaccgagagacgtaattcccgaaagaacgtacgggtatacttacttaanaaaattcgaaactaaacccgtggaaccgaacggaccccgaacggtaaccgtaacccgggttacccgtttttaaattaccgtaggttacggaccggtaaaggtagttaacgttcggttaagggttcgggggttacccgggacccttcgttaaccccgttggttacctaacgttcgacttcgtcggttcgggggtcccg

SEQ ID NO: 408814 - DNA, 517 bp, Homo sapiens
  misc_feature: GZ8MTXP01AF5QT.3.82.H05.1.454.CMB.2.raw
  modified_base (378)..(378): a, c, t, g, unknown or other
  modified_base (450)..(450): a, c, t, g, unknown or other
  modified_base (460)..(460): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggctactcgtcggttttaacagatggttagtctggtatcagacagaaaccgagggaacgcccctgacgttctgatgtctgctgcatcccaccctgacaaagtgacgtccatccagattcagcgtcaagtgaaagtcgtagggacagtacgttcacttcncaccatcacgcagcctgcagtcctagaagtctttcgactaaacctttactaattcgacaacgaggctagacncgtctcccgnttcacgttcggaggacggacgaggttgaagactaacgaacgacgttgcggttcaacg

SEQ ID NO: 408815 - DNA, 608 bp, Homo sapiens
  misc_feature: GZ8MTXP01CCYJG.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctcggcttcaccgtcagtagcagctacatgcacgtcgggtcccgccaggcctaccggagggggacgggggctgggaggtgggtctacgtagtttattacaacttcgtaggtaccactataacctacctccgacccgtgaaacgggccacttaaccatcctaccagacgacgattccgaagaactacggtagtatactacaaatgaaacacgtagacgacgaccgacgacgacggtacgtttatacgtgcgcgagtaacgagttcggaggttcgggttaccggggaccttccgttaccccgttgggtttccctacgttcgtacgttccgttacggtcgggggccgttccgggg

SEQ ID NO: 408816 - DNA, 686 bp, Homo sapiens
  misc_feature: GZ8MTXP01DVO7R.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctctgtgcacgcctctggcttcgaccgtcagtagcagctacatcgcacgtcgggtcccgccgaggcctaccggaagggggaacggggcgtgggaggtgggtctcgtagtttatttactaacttcgtacggtaaccactacttaaacctacccgtcccggaccccgtagggaaccgggacccgtaactttaacccgattaccctaccgaagtaacggtaaccgtaacttacccggaaagtaaaccgtacggttagttaactaccttaacaaaacttacgaaacctaaccgtaggaacggaacggacccgaacgaaccgtaccggttaccgtttaatacgtggtacgacgaagtaagtacgttcgggaaggttcggggtaccggggtccttaccgttccgttcggttaacttacgttcgtactcgttcggtcggggttccgtcgg

SEQ ID NO: 408817 - DNA, 662 bp, Homo sapiens
  misc_feature: GZ8MTXP01EM2AB.3.82.H05.1.454.CMB.2.raw
  modified_base (297)..(297): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtcctgagactctcctgtgcagcctctggcttcaccgtcagtagcagctacatgcacgtgggtccnccgaggcctccggaagggggacggggtcgtgggtaggtggggtctacgtagttacttactaacttcgtaggtaccacgtactaacctactcccggtacccgtaggaaacgggcctaacgttaaccatactaccgaagtacggacgacttaccggaagtaaaccgtaggttatactacttacaaaattacgaaactaaccggtagaaggaccgaccccggaacgtaaccgtaccgggttaccgttttaaatccgttggacggtacgaaggtaagtaagtttcggacggtttcggggtaccggggtacccttccgttaccggttggttaacccttcgtcgtacttcgttcggtcggggttccgtcgg

SEQ ID NO: 408818 - DNA, 636 bp, Homo sapiens
  misc_feature: GZ8MTXP01B9CE3.3.82.H05.1.454.CMB.2.raw
  modified_base (471)..(471): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtgggaggaggcttgatccagccgtgggggtccctgagactctcctgtgcacgcctctggcttcaccgtcagtagcagctacatcgcacgtcgggtccgccgaggcctccggaagggggacggggcgtgggaggtgggtctacgtagtttatttacaactttcgtagtaccactactaacctacccgtcccggacccgtaggaaccgggccgtaacttaaccatcctacgaagacgacgtacttaccgaagtaaacgtacgggttntaacttcgttaacaaaattcgaaacctaacggtgaacggcgacccgaagaccgacggttcctttaatcgtgtcgacgagtaacgtagttcgggacggttcgggtaccgggcccttccgcccgttggttaacctacgttcgactcgttcgggtcggggccgtcggg

SEQ ID NO: 408819 - DNA, 700 bp, Homo sapiens
  misc_feature: GZ8MTXP01CUC2Y.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactcggggtccgccgaggctaccgagggggaagggggctgggaggtggggtctcgtaagtttatttactaaactttcgtaggtacccaacgtactaaacccttaaccgtccccggaaccccggtagggaaacggggaccgtaacttaaacccatcctaccgagacggacgtaacgttccgaagaaaccgtacggtgtaactcttacaaatacgaaaccaaccgtgaaggacgacccggtaacgaccgtaccggtaccgttttaacgtacgttcggtagaccggtaaggaaggttaacgttaccgggtaagggttccgggggtttacccgggggtacccttaccgttaccccggttcggtttaaccttaccgttcggtaacttccggttcggttccggggggcccgttcccgggg

SEQ ID NO: 408820 - DNA, 700 bp, Homo sapiens
  misc_feature: GZ8MTXP01CE4HK.3.82.H05.1.454.CMB.2.raw
  modified_base (261)..(261): a, c, t, g, unknown or other
  modified_base (293)..(293): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagtcttgggttttccttgttgcttatttacaaaaggtgtccagtgtgaggtgcgaggtggtggagacgtgggaggaggcttgatccgagccgtgggggtccctgagactctctgtgcncgcctctggccttcaccgtcagtagcagctanatgacacgtcgggtcccgccgacggccgtaccggagggggaacgggggcgtgggaggttcgggtctacgtaagtttaactttacgaaatttcgtacgtaacccaactaacttaaccctacccgtaccccgggaaccccggtaggaaaccgggtacccgtaaacttaaacccacgttcctaccgaaaggacgtaaaccgacgttaaccccgaaagtaaaccgtacgggttataacttactaacaaaattacgggaaaacctaaccgtagaacgaccgacccgaaacgtaccgtaacggttccgttttaatacgtgtacggaacgaggttacgtacgttacggagggttcgggttacccgggcccttcgtaacccgttggttcctacgtcgattccggttcggtcgggg

SEQ ID NO: 408821 - DNA, 588 bp, Homo sapiens
  misc_feature: GZ8MTXP01AXOLP.3.82.H05.1.454.CMB.2.raw
  modified_base (357)..(357): a, c, t, g, unknown or other
  modified_base (517)..(517): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtcccgccaggcctccgaggggaggggctgggagtgggtctcagttattacaacttctggtaccanactaacctaccgtccgaccccgtggaaacgggccgtattaaccattcctaccgagaacgaaccgattaccggaagaaaccgtacggttgtactacgttacaaaattgaaaccaacgtgaagacgaccgacgaccgacgtaccgtttatactgtgtcgagntagttcggagttcggtcggggaccttcgacccttggttcctacgtcgtatcgttcgtcggggcccgtcggg

SEQ ID NO: 408822 - DNA, 689 bp, Homo sapiens
  misc_feature: GZ8MTXP01B6Y1P.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctggcttcaccgtcagtacgcagctacatgcacgtcgggtcccgccgaggctaccggagggggaaggggcgtgggaggtgggtctcgtaagttatttactaacttcgtagtaccacactaaacctaccgtcccgacccgtagggaacgggaccgtaataacccgatcccgtaccaagtacgaacgtacgttacccggaagaaaccgtacgggttattaactaccttaacgaaaattacggaaacctaaccggtaggaacgaccgacccggtaaccgacgtacccgggttaccgttttaaataacgttgggtaacgcggaaaggtaacggttaattcgggtagggttccggggttaccggggccctttacccgccgttcgggttaacctacgtttcggtactccggttcggtcgggggttaacccgttccggg

SEQ ID NO: 408823 - DNA, 581 bp, Homo sapiens
  misc_feature: GZ8MTXP01EDJ6R.3.82.H05.1.454.CMB.2.raw
  modified_base (437)..(437): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtgggtcccgccaggcctaccgagggggagggggctgggagtgggtctcgtagttatttacaattctaggtaccactataacctactcccgacccgtagaacgggccaattaaccatctccagagacgattaccgaagaacgacggtntatcttacaaatgaaacaaccgtgagacgaccgagaccgacgtccgtttatctgtgcgagaagtagttcggaggttcgggtccggggaacccttcgacccgttgggttcctacgttcgattccgttcggtcggggccgtccggg

SEQ ID NO: 408824 - DNA, 718 bp, Homo sapiens
  misc_feature: GZ8MTXP01CFQG4.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccgagccgtgggggtcctgagactctctgtgcacgcctcgtggcttcgaccgtcagtagcagctacatcgcacgtcgggtccgaccgacggccgtaccggagggggaacgggggtcgtaggggtaggttcgggggtacttacgttaaggtttaactttaacgtaactttcgtacggtaaccctactaacttaaaccctaacccgtccccggaacccgtagggaaacgggtcccgtaacttaaacccactccctaccgaagtacgaacgtacgttacccgaagaactacgggtatactactaacaaatcgaaaccaccggtagacgaaccgacccggaacgacccgtacgggttacgttttaataccgtaggttcgacgtaaacggtaaggttaacgttcgggtaaggggtttccggggttacccggggaccctttaccgttcccgtttggtttaaccttacgttcgtactccggttcgggtcggggttcccgtaaccgg

SEQ ID NO: 408825 - DNA, 807 bp, Homo sapiens
  misc_feature: GZ8MTXP01ENNM1.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagacgtggaggaggcttgatccagccgtgggggtcctgagactctcctgtgcagcctctggcttcaccgtcagtgcagctacatgcacgtcgggtccgccaggcctaccggaggggaacgggggctagggaggtggggtctacgtaggtttactttactaaacgtttctacggtaaccactacttaaacccgtacccgtcccggaaccccggtagggaaacggggtaccctaaactttaaaccccgacttaccctacccgaaggtaacggtaaaccggtaacgtttacccggaaaacgtaaaccggtaaccggggtttaagtaactttacccgtttaaacaaaaaacgttaccgggaaaaaccctaaacccgggttagggaaaaccggtacgggaaccccgaaacggtaaccctaacccgggggttaccccttttttaaagtacgttcggtaccggaacggtaaggaaacggtacgtttcgggaacggggtttcggggttacccgggggtaacccttcccggttaaccccgtttcggggttttcccctaaacggtttccgtaacggtttcccgttccgggggttccgggggttccccgtttcccggggg

SEQ ID NO: 408826 - DNA, 645 bp, Homo sapiens
  misc_feature: GZ8MTXP01B5MYV.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccggtcgggggtcctgagctctcctgtgcacgtcctcgtcggcttccgaccgtcagtagcagctacatgctacgtcgggcccgcgaggccgtacggaggggagggcgtgggaggtcgggtctcgtagttattactaacttcgtacgtacactactaacctaccgtcccgacccgtaggaacgggtacctaacttaaccgactacctaccgaagaacgtacgtacgttaccggaaagaaaccgtacgggttataacttacttaacaaagtacgaaacctaacggtggaacgaccgaccgaacgaccgtaccggtactttaatacgtgtcgacgagtaacgtagttcggaggttcgggtaccggtcccttcgttacccgttggttaactcgtcgtacgttccgttcggtccggggttcgtccgg

SEQ ID NO: 408827 - DNA, 681 bp, Homo sapiens
  misc_feature: GZ8MTXP01A1VNU.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagacgtggaggaggcttgatccagccgtgggggtccctgagactctcctgtgcagcctctcggcttcaccgtcagtagcagctacatcgcacgtcgggtcccgccgaggccgtaccggaagggggaacgggggcgtggggaggttcggggtcttacgtaagtttaactttactaactttcgtaggtacccactacttaaacctacccgtcccgaccccggtaggaaacggggcccgtaacttaaacccattccctaccgaggacggaacgtacttacccggaagaaaccgtacgggttagtacttacgttaacaaaagttcgaaaccaccggtaggaacgacgacccgaacgaccgtaccggttaccgttttaagtaccgtggtgacgaaggtaagtacgtttcggacggttcggggttaccgggacccttccgttaccgttggtttctaccgttcgattcgttcgggtcggggcccgtcggg

SEQ ID NO: 408828 - DNA, 591 bp, Homo sapiens
  misc_feature: GZ8MTXP01D54II.3.82.H05.1.454.CMB.2.raw
  modified_base (445)..(445): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcacgcctctggcttcaccgtcagtagcagctacatgcacgtgggtcccgccaggcctccgaaggggaggggctgggagtgggtctcgtagttatttacaacttctaggtaccacataaccctacctcccgacccgtaggaaacgggccgtaattaaccatcctaccagacgacgacttaccgaagaacgacggtntactcttacaaatacgaaacaacgtagagacgaccgacgacgacgtcgtttaatactgtgcgagaagtgttgaggttcggtaccggggtccttacgttcccgttggttccttacgttcgtactcgttcgtcggggttccgtaacgg

SEQ ID NO: 408829 - DNA, 606 bp, Homo sapiens
  misc_feature: GZ8MTXP01ED9VJ.3.82.H05.1.454.CMB.2.raw
  modified_base (424)..(424): a, c, t, g, unknown or other
  modified_base (587)..(587): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcacgcctctggcttcaccgtcagtagcagctacatgcacgtcgggtccgccgaggcctaccggagggggaacgggggtcgtgggaggtcggggtctacgtagtttactttactaacttcgtacggtaccactactaacctactcccgacccgtgaacgggccgtacttaaccntcctcagacgacgacttacggaagtaacgtacggtagtatacttacaaatagaaacaacggtagaacgacgaccgacgaccgacggttaccgtttataccgtgtgcgagaagtgttgaggttcgggtccggggaccttcgttcccgttggttcttacgtcgtntcgttcggtcgggccgtcg

SEQ ID NO: 408830 - DNA, 672 bp, Homo sapiens
  misc_feature: GZ8MTXP01EJGUI.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccgagccgtgggggtccctgagactctcctgtgcagcctctggcttcaccgtcagtagcagctacatgcacgtcgggtcccgccgaggcctccggagggggaagggggcgtgggtagttggggtcttcgtagtttatttactaacttcgtacggtaacccactaacttaaccctaaccgtcccggtaaccccgtgggaaacgggtccctaattaaacccatcctaccgaagtacgaacgtacgttacccgaagtaaacccgtgggttataactacttaacaaattacgaaacctaccgtaggaacgaccgacccggaaacgtaccgtaccgggttcctttaaataccgtggtagcggtaaatggtaattcgggaagtttcgggggtaccgggaccttccggccgtttagggtccttaacgttcgacttccgttcgggtccggggaaccgttcgg

SEQ ID NO: 408831 - DNA, 699 bp, Homo sapiens
  misc_feature: GZ8MTXP01ER9UM.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctattcaaaggtgtccagtgtgaggtgcaggtggtggagactggaggaggcttgatccagccgtgggggtccctgagactctcctgtgcacgcctctggcttcaccgtcagtagcagctacatgcacgtgggtcccgccaggctccggaagggggaacggggcgtgggaggttgggtcttacgtagtttattactaacttcgtaggtaacccactactaacctacctcccggaccccgtagggaaccgggaccgtaactttaacccatccgtacccaaggaacgaacgtacgttacccggaagtaaaccgtacgggtttagtaactacttacaaaacgtacgaaacctaaccggtggaaacggaaccgacccggaaacgaaccgtaccgggttacccttttaagtaccgtggtacgacggtaagaacggttaacttcgggaaggtttcggggtaccggggtacccttaccgttacccggtttcggtttccttaccgtttccggtacgttccggttcgggtccgggggttcccgtccggg

SEQ ID NO: 408832 - DNA, 769 bp, Homo sapiens
  misc_feature: GZ8MTXP01B41LV.3.82.H05.1.454.CMB.2.raw
  modified_base (502)..(502): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggtttttccttgttgcttatttcaaaaggtgtccagtgtgaggtgcgaggtggtggagacgtggaggaggcttgatccgagccgtgggggtcctgagactcgctgcgctaccttctggattcaccttcacgctacaagtcggaccacgtacggtggacgtcgggtcccgccgacggctaccggagggggaagggggtcgtgggtagggttggggttcgggtccgtttacgtaggacggaaccaacccaaacctaaacgaggtacgaaccaaacccgacaaccgaaacgtacccggcccgtcgtcgtaggtacgggaaaacgctagtaacttccaacctataccctaagaaagtanaagtgtaacttaacgaagtaacgttaaaccttctttaaatttttacgaccgttaacggaaactaaaagttcggaaaaacctcggttaccccgtaaaggaaaacccggaaaccccgggtaacccggaaacccgggttaacccggggttccccgtttaaatttaaaacgtttttcggtttaaggttccgttaaaccgtaagttaaaccggtaacccgtttaaaggggaccttaaaaccgggtaaaccggggttccggggtttaaccggg

SEQ ID NO: 408833 - DNA, 664 bp, Homo sapiens
  misc_feature: GZ8MTXP01A1C9B.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctattcaaaaggtgtccagtgtgaggtgcaggtggtggagactggaggaggcttgatccagccgtgggggtccctgagactctcctgtgcagcctctggcttcaccgtcagtagcagctacatgcacgtcgggtcccgccaggctccgagggggaaggggctgggagtgggtctcgtagtttactttacaattcgtacggtacccaaacacttaacctaccgtaccccgaaccccggttagggaaaccggggtcccgtaaactttaaacccattccctacccgaaggaacgtaccgtaacttaccccggaagtaaaccgtacggggttataacttcttaacaaaattcggggaaaacctaaccgtgaacggacgacccgaacgaccgtaacggtccgttttaaatacgtggtagcgtaagatacgttcggaaggttcggggttcccgggaccttcccgtaaccccgttggttccctacgttcgactccgttcgggtcggggg

SEQ ID NO: 408834 - DNA, 616 bp, Homo sapiens
  misc_feature: GZ8MTXP01A2U99.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtcccgccaggctccgagggggaggggctgggagtgggtctcgtagttattactaacttcgtaggtaccacataacctactcccgacccgtgaacgggccgattaaccatctaccagacgacgtattaccgagaaacgtcggttagtactcttaacgaaattacgaaacctaaccgtggaacgacgacccgaacgaccacgggttaccttttaatccgtgtcgacgaggtaagtagttcggaaggttcgggttaccggggacccttcgacccgttgggttaaccctacgttcgacttccgttcggtcgggggttccctccggg

SEQ ID NO: 408835 - DNA, 550 bp, Homo sapiens
  misc_feature: GZ8MTXP01DWBW8.3.82.H05.1.454.CMB.2.raw
  modified_base (299)..(299): a, c, t, g, unknown or other
  modified_base (524)..(524): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttggtcgggcgactcggtacggttttaacagtatggttagtctggtatcagacaagaaaccgagggaaacgcccctgacgttccngatgtctgctgctactcccacctgacaaagtcgacgtcccatccagtatcagcgtcaagtagtaaatcgtagggactaggtacttcactctacaccatcagctacgcctgacacgtacctagtaacgttagttttacgacttaaactttactattacgtacaacgagtctagactcgtccctccgtcttcgtacgttcgggacggtacggacgagggttacgaanagtaacaaacggagttggtcgcgtcg

SEQ ID NO: 408836 - DNA, 642 bp, Homo sapiens
  misc_feature: GZ8MTXP01ES95O.3.82.H05.1.454.CMB.2.raw
  modified_base (618)..(618): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcacgcctcgtcggtcttccaccgtcagtacgcagctacatgccacgtcgggtccccgccgaggcctaccggaagggggaacgggggcgtgggaggttcggggtctcgtaagtttattactaacttcgtaggtaaccactactaacctacctcccgacccgtagaaccgggccgtaactaaccactactacaagacgacgtacttccgaagtaaccgtacggttatactcttaacaaatacgaaacctaacggtagaacgacgcccggaacgaccgaccggttactttaatccgtgtcgacgagtaagtacgttacggaggttcgggtacccggggtaccttccgacccgtttggttccctacgttcgntccgttcggtcggggttccgtcgg

SEQ ID NO: 408837 - DNA, 561 bp, Homo sapiens
  misc_feature: GZ8MTXP01B25SM.3.82.H05.1.454.CMB.2.raw
  modified_base (413)..(413): a, c, t, g, unknown or other
  modified_base (435)..(435): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtcgggtcccgccgaggcctccgagggggaagggggctgggagttggggtctcgtagtttacttacaattcgtggtaccaactataacctactcccgacccgtgaacgggccgaattaaccntctcagagacgatccgagaacncggtgtatctacaaatcggaactaacctgacgacgccgacgacaccggtctttagtactgtgcgagagtattcggagtgggttcgggccttcgaacccgttgtcttactcgatccgttcgtcgggg

SEQ ID NO: 408838 - DNA, 570 bp, Homo sapiens
  misc_feature: GZ8MTXP01C94GP.3.82.H05.1.454.CMB.2.raw
  modified_base (393)..(393): a, c, t, g, unknown or other
  modified_base (422)..(422): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtggggggtccctgagactctcctgtgcagcctctggcttcaccgtcagtagcagctacatgcacgtgggtccgcaggctccgaggggaggggctgggagtgggtctcgagttattacaattctggtaccacataactactcccgacccgtgaaagggccgataaccntctcagagacgattccgaagaacacggtntatcttacaaatgaaaccaacgtgaagacgaccgacgacgacgggtccttttaaatacgtgtggacgagaagtatttcggagttcgggttccggggaccttcgacccgttggttctaacttcgtatccgttcgtcgggggcccgtcgg

SEQ ID NO: 408839 - DNA, 607 bp, Homo sapiens
  misc_feature: GZ8MTXP01BVVPU.3.82.H05.1.454.CMB.2.raw
  modified_base (310)..(310): a, c, t, g, unknown or other
  modified_base (352)..(352): a, c, t, g, unknown or other
  modified_base (359)..(359): a, c, t, g, unknown or other
  modified_base (397)..(397): a, c, t, g, unknown or other
tcagagacgcactccacgaccggtgctcgatttagtcgagctctctcgcggggagtcagacccagtcaggacacagcatggacatgagggtccccgctcagctcctggggctcctgctgctctggttcccaggttccagatgcgacatccagatgacccagtctccatcctccgtgtctgcatcgtgtaggggacagagtcgctatgtacttgtcgggcgactcggtacggttttaacagtattgggtttagtcgttgggtaatcaagacaaaggaaaaccgagggaaaacgccccgtagaacgtttccngtatgtctgctgcatcccacctgacaaagtgactccatcagntcagctnaaagtgaatctagggacagtacttcactctacacaacncagctagtcgcgacgacgacgtagtaagttacgtttacgtaacgttaacttaacgttaacgttacgtacgtaacgtacgtacgtacgtacgtaccgtaccgtcccgtccgtaaccgtacggttacgggtacgggaacgggtaacggtaacgggttacggagaacgtaacgaaacgtaacgtacggtacggttacgtaacgaacgtaaccg

SEQ ID NO: 408840 - DNA, 565 bp, Homo sapiens
  misc_feature: GZ8MTXP01ALBS4.3.82.H05.1.454.CMB.2.raw
  modified_base (258)..(258): a, c, t, g, unknown or other
  modified_base (354)..(354): a, c, t, g, unknown or other
  modified_base (501)..(501): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccgagccgtggggggtccctgagactctctgtgcagcctntggcttcaccgtcagtagcagctacatgcactgggtccgccaggctccgaggggagggctggagtgggtctcagttatttacaattctggtaccanataacctactccgaccccgtagaacgggccctaattaaccatctaccagagaacgattaccgagaacctacggtatatcttacaaatcgaaacaaccgtgaagcgacccgaacgaccgacgtccgtttaataccgtgtagcgagaancgttcgaggttggttccggggaacttcgacccttgggtctacgttcgctcgcgtgggccgtcgg

SEQ ID NO: 408841 - DNA, 708 bp, Homo sapiens
  misc_feature: GZ8MTXP01A7AQV.3.82.H05.1.454.CMB.2.raw
tcagagacgcactccacgaccggtgctcgatttagtcgagctctctcgcggggctgggagaggagcccagcaccgggattccgaggtgtttccattcggtgatcagcactgaacacagaggactcaccatggagttttggctgagcttgggttttccttgttgcttatttacaaaaggtgtccagtgtgaggtgcaggtggtggagacgtgggaggaggcttgactccgaggccggtgggggtccctgagactctcctgtgcagcctctggctcaccgtcagtagcagctacatcgacaccggtcggggtccccgccgacggccgtaccggagggggaacgggtcgtagggaggttcgggttctacgtaagtttacgtttaaccctagtttcgtacggtaacccacgtaaacttaaccctaacccgtacccgtaaacccccgggtaggaaaccgggtaccgtaaacttaaacccgactaccctacgaaggtacgaaccgtacttacccggaaagtaaccgtacggttattaactacgttaacaaacgtacgaaacctacgtaggaacgacgaccgacgacgtaccggttaccgtttatcgtgtcgacggtaagtacggttacgttacggagggttccgggttaccgggttaccccttcggttaccccgttggttaccttcgtacgtcgttccgtcggttccgggtccg

SEQ ID NO: 408842 - DNA, 608 bp, Homo sapiens
  misc_feature: GZ8MTXP01AYP2S.3.82.H05.1.454.CMB.2.raw
  modified_base (524)..(524): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctcggcttcaccgtcagtagcagctacatgcacgtcgggtccgccgacgggcctccggaagggggaacggggcgtgggaggtggggtctcgtagttatttactaactttcgtaggtaacccactactaacctacctcccggaccccggtaggaaacgggcccgtaacttaaccatcctccgagacgacgattaccggaagtaaacgtcggtatactcttacaaagtcgaaaccacgtgagacgccgacgacacggtctttaatcgtgngcgaagcgtagttcggaggttcggggtccgggaccttccgaccgttgttaacctcttcgacttccgttcggtgggggccctggg

SEQ ID NO: 408843 - DNA, 678 bp, Homo sapiens
  misc_feature: GZ8MTXP01CJVK3.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccagccgtgggggtccctgagactctcctgtgcagcctctggcttcaccgtcagtagcagctacatgcacgtcggtcccgccgacggctaccggagggggaacggggcgtgggaggttgggtctacgtagtttaactttacaatttcgtacggtaacctaaactaacttaacctaccgtaccccggaaaccccggttaggaaaccggggtaccgtaaactttaaacccgattccgtaacccgaaggaacgtaaaccggtactttacccggaaagtaaaccgtacgggtattacttaccgttaacaaaagttacgaaactaaaccgtggacgaacgacccgaacgacgtaaccgggttcctttaataccgtggtcggaacgagagtagttcggaggttcgggttaccgggccttcgtaaccgttggttcctacgttcgacttccgttcggtccgggg

SEQ ID NO: 408844 - DNA, 694 bp, Homo sapiens
  misc_feature: GZ8MTXP01ALZKV.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagactggaggaggcttgatccagccgtgggggtccctgagactctcctgtgcagcctcgtggcttcaccgtcagtagcagctacatgcacgtcggtccgcgaggctccggaggggaagggctgggagtgggtctacgtagtttactttacaagtttcgtacggtaacccaaactaacttaaccgtacccgtacccggaaccccggttaggaaccggggtacccgtaaactttaaacccgacttaccgtaccgaaggacgtaacgtacgttacccggaaagtaaaccgtacgggtgttaactcttaacaaagtacgggaaactaaccgtaggaaggaccgcccgaacgaccgtaaccggggttacctttattaaccgtggtacggaacggtaaggacgttacgttacgggaacggtttcggggttcccggggttacccttccgttaacccggtggtttcctacgttacggttacttcgttcggtcccggggg

SEQ ID NO: 408845 - DNA, 682 bp, Homo sapiens
  misc_feature: GZ8MTXP01AVEA3.3.82.H05.1.454.CMB.2.raw
  modified_base (514)..(514): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccgagccgtgggggtccctgagactctcctgtgcagcctcgtcggcttcgaccgtcagtagcagctacatgcacgtcgggtcccgccgaggcctaccggaagggggaacgggggcgtaggggaggttcggggtctacgtaagtttaatttaactaacgttcgtacggtaacccactaacttaaacctaccgtcccgacccgtagggaaacggggtaccctaagttaaccacttccaccaaggtacgaaccgtacttacccggaagtaaaccgtcgggttataactaccttaaaanaaacgtacgaaaccacggtaggaacgaccgaccgaacgtacgtaccggttactttaagtcgtggtacgacgtaagaacgttacgttcgggtacggttcggggtacccggtacccttccgttccgttcggttaacctacgtcgtactccggttcgggtccgggccgtcg

SEQ ID NO: 408846 - DNA, 570 bp, Homo sapiens
  misc_feature: GZ8MTXP01D6QUW.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtcctgagactctcctgtgcagcctctggcttcaccgtcagtagcagctacatgcacgtgggtccgccaggctccgagggggagggctgggagtgggtctcgtagtttattacaattctaggtaccacataacctactcccgacccgtagaaacgggccaattaaccatctaccagagacgattccgagaaacgacggtagtactcttacgaaatcgaaacacgtgaagacgaccgagacacggtcgtttaatacgtgtgcgagaacgtagttgaggttgggtccggggaccttcgttacccgttggttcctacgttcgattcgttcgtcggggccgtcgg

SEQ ID NO: 408847 - DNA, 735 bp, Homo sapiens
  misc_feature: GZ8MTXP01C2E4S.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtgggaggaggcttgatccgagccgtgggggtccctgagactctcctgtgcacgcctctggcttcgaccgtcagtagcagctacatcgcacgtgggtcccgccgaggccgtaccggagggggaggggcgtgggtaggtgggtctacgtaagtttatttaactaactttcgtacgtaccactactaaccctaccgtcccggaccccgtaggaaccggggtaccctaacgttaacccactcctacccgaaggacgtaaccgtaacgttacccgaaaggtaaacgtacgggttataaccgttcttaaacaaagttaccgaaaaccaaccggtaggaacggaacgacccggaaacgtaacccgtaccggttaccgtttaaacgttaccgtgggtacggaccggtaaagtaacggttaacgtttaccggggtagggttccggggtttacccggggtacccttaccgttacccgtttgggtttaacctaacggtttcgaacgttccggttccgggttccgggggttcccgttccggg

SEQ ID NO: 408848 - DNA, 729 bp, Homo sapiens
  misc_feature: GZ8MTXP01CQRL5.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtcctgagactctctgtgcagcctctggcttcaccgtcagtacgcagctacatgcacgtcgggtcccgccgaggcctccgagggggaacgggggcgtagggaggtcgggtctctagtttactttaacaactttcgtaggtaccaactacttaaaccctaccctcccggaccccgtaggaaacggggtaccgtaacttaacccgatccctaccgaagacggtaaccgaagttacccggaaagaaaccgtacggttagttaactaccttaacgaaaacttacggaaaacctaaacccggggttggaaacggtaccgggacccggaaccgtaacccgtaccgggtttacccggttttaattaccggtaggttacggaccggaaggtaagtacgttaccgggtaagggttcgggggttacccggggacccttaccgttaccccgttgggtttcccgtacgtttccgggattccggttccggtcgggggttcccgttaacgggg

SEQ ID NO: 408849 - DNA, 680 bp, Homo sapiens
  misc_feature: GZ8MTXP01EWQ30.3.82.H05.1.454.CMB.2.raw
  modified_base (271)..(271): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtggaggaggcttgatccagccgtgggggtcctgagactctcctgtgcagcctctggcttcaccgtnagtagcagctacatcgcacgtcgggtcccgcgacggctccgaagggggacggggctgggaggtcgggtcttcgtagtttactttaactaactttcgtacggtaccacgtacttaaaccctaaccgtccccggaaccccgtagggaaacggggtacccgtaaacttaaacccgattccctacccgaagacgtaaccgacgtttaccgaagtaaaccgtacgggttagtaactcgttaaccaaaattacgaaaaccaaccggttgaaaggaccgacccgaacgaaccgtacggttacccgtttattaccgtgtacgccgaagtaagtaacttcgggaggttcgggttaccggggacccttccgttacccgttgttcctcgttcgtactcgttcggtccggggttcgtccgg

SEQ ID NO: 408850 - DNA, 705 bp, Homo sapiens
  misc_feature: GZ8MTXP01C135Q.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccgagccgtgggggtcctgagactctcctgtgcacgcctcgtggcttcaccgtcagtagcagctacatgcacgtcgggtcccgccgaggcctaccggagggggaacggggcgtgggaggtggggtctacgtaagtttactttaactaactttcgtacggtaaccaactaacttaaacctacctcccggtaaccccgtgggaaaccgggccgtaacttaaacccataccctacccaaggacgtaaccgtacttacccggaaaggtaaaccgtacgggttataacttaccttaaacgaaaagttacggaaaacctaaccggtaggaaacggacgacccggaactaccgaccggttaccgttttaataccgtggtacgacggtaagaagttaacgttcgggtaacggttcggggttacccgggaccttacccgttcccggtttaggttcctacgttcgtacttccgttcgggtcggggcccgttccggg

SEQ ID NO: 408851 - DNA, 796 bp, Homo sapiens
  misc_feature: GZ8MTXP01BI8Y0.3.82.H05.1.454.CMB.2.raw
  modified_base (305)..(305): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccgagccgtgggggtccctgacgactctcctgtgcacgcctcgtggcttcgaccgtcagtagcagctacatgctacgtcgggtccnccgaggctccggaagggggagggggtcgtagggaggtcgggtcttacgtagtttatttacaaactttcgtacggtaacctacaacttaacctacccgtcccggaccccgtagggaaaccgggccctaacgttaacccacgttcctacccgaaggaacgtaaccggtacgttacccggaaagtaaaccgtaccggggttaattacctaccgttaaacaaaattacggaaaaccctaacggtacggaaggaacccgacccggtaaaccggaaccgtaacccgggttaccgtttttaaactacggtacggttacggaaccggtaaaggtaacggttaaacggtttccgggtaaacgggtttccgggggtttacccgggggtaaccccctttacccgggttccccgttttaacggggttttcccttaaacccgttttccgggaacttttcccggggttacccggggttccggggggttcccccgtttcccggggg

SEQ ID NO: 408852 - DNA, 644 bp, Homo sapiens
  misc_feature: GZ8MTXP01CZ5U8.3.82.H05.1.454.CMB.2.raw
  modified_base (279)..(279): a, c, t, g, unknown or other
  modified_base (379)..(379): a, c, t, g, unknown or other
  modified_base (407)..(407): a, c, t, g, unknown or other
  modified_base (449)..(449): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtgggaggaggcttgatccgagccgtggggggtccctgagactctcctgtgcagcctctggcttcaccgtcagtancagctacatgcacgtcgggtcccgccaggcctcgagggggaggggctgggagtgggtctcgtagttatttacaactttcgaggtaccactataacctacncccgacccgtgaacgggccgtataaccntcctaccgagacgacgtacttaccgaagaaacgtacgggttntaacttccttaacaaaacgttcgaaaacccaaccggttaggaacggaaccgacccgaacgaaccgtaccgggttccttttaatacgtggtacgacgtaaggtaacgtacgttcgggaggttcgggttaccggggacccttccgttacccggttggtttcctacgttcgacgttcgttcggtcggggccgttccgg

SEQ ID NO: 408853 - DNA, 606 bp, Homo sapiens
  misc_feature: GZ8MTXP01DE9CL.3.82.H05.1.454.CMB.2.raw
  modified_base (288)..(288): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatcgtggtaggggacagagtcgctatgacttggtcgggcgacgtcggtacggttttaacagtagttggttagtctggtatcagcaagaaaccgagggaaacncccctgagttcctgatgtctgctgctactcccaccctgactaaaggtcgacgtccccatccagtattcagcgtcaagtgaaatcgtagggacagtacgttcacttctaccacatcacgcacgcctagcacgcctagaagttagttttacgacttaaacgtttctaattcgtaacaacgtacgggtctagacctacggttccctcccgtcttccgttaaccggtttccggggaacggggtacggggttaaaccggttagggttacgggtaacgtaacgttaaccgaaaacgggtacttcgggtaacggttcctaaccgg

SEQ ID NO: 408854 - DNA, 715 bp, Homo sapiens
  misc_feature: GZ8MTXP01EPR7D.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtcctgagactctcctgtgcagcctctggcttcaccgtcagtagcagctacatcgcacgtcgggtcccgccgaggccgtccgaagggggagggggtcgtgggaggtggggtcttctagtttactttactaactttcgtaggtaacccactactaaaccctaccgtcccggaccccgtaggaaacggggcccgtaattaacccagtccctaccgaagaacgaccgtaattaccccggaagtaaaccgtacgggttataacttaccttaacaaaattacgaaaaccctaaccgggtgaaacggaccgaccccgtaacgaccgtaccgggttccttttaagttacgtggtcgaccggaaggtaagtacgtttaccggaaggggtttccggggttcccgggggaacccttcccgttaccccggtttgggtttaaccccttacgttccgggtacttccggttccggttccggggggttcccgttccgggg

SEQ ID NO: 408855 - DNA, 752 bp, Homo sapiens
  misc_feature: GZ8MTXP01BKR69.3.82.H05.1.454.CMB.2.raw
  modified_base (258)..(258): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctntggcttcaccgtcagtagcagctacatcgcacgtcgggtcccgccgagggcctaccggaagggggaacgggggtcgtggggaggttgggggttccttacgtaaggtttaactttaacgtaaacgtttccgtacgggtaacccaactacttaaacccgttacccgtccccggaacccccgggtagggaaaccgggggtccctaaactttaaacccacttcctacccgaagaacgacgtaacgttacccggaagtaaaccgtacgggttataacttaccttaacaaaattacgaaaaccctaaccggtaggaaacggaccgacccggaaacgacccgtaacgggttacccgttttaagttaccgtggttacgacggtaagtaaggtacgtttcgggtaagggttcggggttaccgggggaactttcccgttcccttacccggtttgggtttaccttaaccgttcgtacgttccggttcgggttcgggggtccccgg

SEQ ID NO: 408856 - DNA, 578 bp, Homo sapiens
  misc_feature: GZ8MTXP01EUVES.3.82.H05.1.454.CMB.2.raw
  modified_base (251)..(251): a, c, t, g, unknown or other
  modified_base (262)..(262): a, c, t, g, unknown or other
  modified_base (269)..(269): a, c, t, g, unknown or other
  modified_base (271)..(272): a, c, t, g, unknown or other
  modified_base (275)..(275): a, c, t, g, unknown or other
  modified_base (279)..(279): a, c, t, g, unknown or other
  modified_base (307)..(307): a, c, t, g, unknown or other
  modified_base (506)..(506): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcgtggtttcgtgtaggctattcaaaaggtgtcagtgtgaggtgcaggtggtggagatggaggaggcttgatccagccgtggggggtccctgagactctcctgtgcncgctctgctcncgcagancnncantgcncgtcggccgcgcgcgacggagggagggnggtggtggtggtcgtacgtagttacttactattacgtacgtacctaactactcctaccgtacccgtacccgtacggacggtacgtactaactactactacgacgacgacgtacgtacgacgaacgtacgtacgtactactactaactaacgaacaacgtacgacgacgacgacgacgtacgtacgttacttacgtgtgngagagtacgttcggtcggtcggttcgggttccgttccgtccgtcgttcgttcgtcgttcgtcgttcggtcgg

SEQ ID NO: 408857 - DNA, 710 bp, Homo sapiens
  misc_feature: GZ8MTXP01AQ7IQ.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtgggagggaggcttgatccgagccgtggggggtccctgagactctcctgtgcagcctcgtggcttcaccgtcagtagcagctacatgcacgtcgggtccgccgaggctccggaggggaggggctgggagtggtctcgtagttacttacattcgtacgtaccaactactaacctaccgtcccgacccgtagaacggggtcctaaacttaaacccacttcctaccgaaggtaacgaaccgtaacgttacccggaaaggtaaaccgtacggggttagttaacttaccttaacgaaaacgttacggggaaaacctaaacccgtaggaacggaccgaaccccggtaacgtaacccgtaacgggtttcccgttttaaagtaccgttaggtcggtaacggtaaaggagtaacgtttcgggtaaacggggttccggggttacccggggttacccttccgtaacccggtttcggttaaccttacgttcgacgttcgttcgggttcccggggg

SEQ ID NO: 408858 - DNA, 740 bp, Homo sapiens
  misc_feature: GZ8MTXP01APULX.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctggcttcaccgtcagtagcagctacatcgctacgtcgggtcccgccgaggcctccggagggggaacgggggcgtagggaggttcggggtccttacgtaagttttaactttaacaagtttcgtacggtaacccaaacgtaacttaaccctaccgtacccccgggtaaaccccggttaggaaaccgggggtacccgtaaacgtttaaaccccacttacccgttacccgaaagggtaacggtaaccgtaacgtttacccgggaaagtaaaccgtacggggttagttaacttaccgttaacaaaagttacggggaaaaccaaacccgttaggaaacggaaccgacccggaacgaaccggtaaccgggttacccgttttaattaccggtgtccggaagaaggttacggtaacgttcgggaaggttcggggttaccgggccttaccgtcccgttggttcctacgtcgacttcgttcggttcggggg

SEQ ID NO: 408859 - DNA, 577 bp, Homo sapiens
  misc_feature: GZ8MTXP01CR4MK.3.82.H05.1.454.CMB.2.raw
  modified_base (169)..(169): a, c, t, g, unknown or other
  modified_base (213)..(213): a, c, t, g, unknown or other
  modified_base (248)..(248): a, c, t, g, unknown or other
  modified_base (268)..(268): a, c, t, g, unknown or other
  modified_base (272)..(272): a, c, t, g, unknown or other
  modified_base (327)..(327): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcggtggtttcgtgtaggctattanaaaggtgtcagtgtgaggtgcaggtggtggagagtggaggaggntgatcagcgtgggggtccgtgagactctctgtgcncgctctgtctcacgtcaganacanactacagtgcgcgtcggtccgcgacgcgcggagggagggcggtggtggtggtctntagttacttactatcgtacgtactaactactaactaccgtaccgaccgtacggacggacgtactactactactacgacgacgacgtacgtacgacgtaacgtacgtacgtactactactaactaacgaactaacgtagacgacgacgacgacgtacgtacgttacttacgtgtgaacgagagtagttcgtacggtcggttcggttccgttaccgtccgttcgttcgttcgtcgttcgtcgttcggtcggg

SEQ ID NO: 408860 - DNA, 688 bp, Homo sapiens
  misc_feature: GZ8MTXP01A26SH.3.82.H05.1.454.CMB.2.raw
  modified_base (507)..(507): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagactggaggaggcttgatccagccgtgggggtcctgagactctcctgtgcagcctcgtggcttcaccgtcagtacgcagctacatcgcacgtcgggtcccgccgagggcctacccggaagggggaacgggggtcgtagggacggttcggggttaccttacgtaagtttaactttaactaactttcgtacggtaacccactactaaacctacccgtcccggaccccggtagggaaaccgggtaccctaacgttaacccactaccctacaaggtaacgacgtacttaccgaagtaaccgtacgggttntaacgtcttaacgaaagtcgaaacctaaccggtggaacgacgacccgaacgacccgtacgggttacctttagtaccgtgggtacgacggagtaacgtacgttcgggtaacggttcggggttacccgggaccttccgcccgttggttaacctacgttcgatccgttcggtcgggccgtccgg

SEQ ID NO: 408861 - DNA, 538 bp, Homo sapiens
  misc_feature: GZ8MTXP01AEWW3.3.82.H05.1.454.CMB.2.raw
  modified_base (298)..(298): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctattcaaaggtgtccagtgtgaggtgcaggtggtggagactggaggaggcttgatccagccgtggggggtccctgagactctcctgtgcagcctctggcttcaccgtcagtagcagctacatgcacgtgggtccncaggctccgaggggaaggggctgggagtgggtctcagtttacttacaattctggtaccaacataactactcccgacccgtgaacgggcattaaccatctaccagacgacgattaccgagaacacggtgtatcttacaaatggaacaactgagacgccgacgacacggcctttatactgtgcgagagattgaggtcggttcggggccttcgaaccttggtctactcgatcgttcgtcgggg

SEQ ID NO: 408862 - DNA, 634 bp, Homo sapiens
  misc_feature: GZ8MTXP01A12Q7.3.82.H05.1.454.CMB.2.raw
  modified_base (480)..(480): a, c, t, g, unknown or other
  modified_base (496)..(496): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcacgcctctggcttcaccgtcagtagcagctacatgcaccgtcgggtcccgccgaggcctaccggaagggggaacgggggcgtggggaggtcggggtctacgtagtttactttactaacttcgtaggtacccaatactaaaccctacctcccggaccccgtagggaaaccgggaccgtaacttaaccgattcctaccagacgacgtacgttaccgaagaacgtacggtntacttctaacaaagtnaaaccacgtagaagacgccgaacgaccgtacggttccttagttctggtgcgaggtaagtcttcgggaggttcgggtacccgggccttcgttaccgttcgttaacgttctcggctccgggttccggggtcttcgggccc

SEQ ID NO: 408863 - DNA, 659 bp, Homo sapiens
  misc_feature: GZ8MTXP01EF362.3.82.H05.1.454.CMB.2.raw
  modified_base (255)..(255): a, c, t, g, unknown or other
  modified_base (280)..(280): a, c, t, g, unknown or other
  modified_base (293)..(293): a, c, t, g, unknown or other
  modified_base (457)..(457): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcgtggttttcctgttagctattacaaaggtgtcagtgtgaggtgcaggtggtggagacgtggaggaggcttgatccagccgtgggggtccctgagactctcctgtgcagcctntggcttcacgtcagtagcagcctantgcacgtcggccncgaggcgtacggagggacgggcgtggagtggtctacgtagttacttacgtacttcgtacgtaccactactaaccctaccgtcccggtacccgtagggaaccggtaccgtaactaaccactaccacgaagacgacgtacgttaccggaaacgtaacgtacggttntactacttaaacgaaacgtacgaaacctacggtacggaacgaccggacccgaacggtaccgtacgttaccgtttaacgtctggtacgacggtaagaagttcggttccgggagggtttccggggtcccgggtacccttcccgttccggtttcggtttaaccttacgttcgtaccgtcccggttcgggtcggggttcccgtccg

SEQ ID NO: 408864 - DNA, 710 bp, Homo sapiens
  misc_feature: GZ8MTXP01BJNEW.3.82.H05.1.454.CMB.2.raw
  modified_base (623)..(623): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcacgcctctggccttcgaccgtcagtagcagctacatgcacgtcgggtcccgccgagggcctaccggaagggggaacgggggtcgtaggggtaggttcgggggtcttacgtaggtttaactttaacgtaactttccgtacggtaacccaacgtacttaaacccttacccgtccccggtaacccccggttagggaaaccggggtcccgtaaacttaacccgacttaccctacccgaagaacggaaccgtacttacccggaagtaaaccgtacgggttattacttaccgttaacaaaacgttacgaaacctaacccggtggaaacggacgacccggaacgacccgacggttaccgttttaactcgtggtcgacgngaagtgttccggaggttcgggtccgggtaccttccgttacccgttggttcctacgttcgacgtccgttcggtcggggttcccgtcgg

SEQ ID NO: 408865 - DNA, 805 bp, Homo sapiens
  misc_feature: GZ8MTXP01DXOP6.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccgagccgtgggggtccctgagactctcctgtgcacgtcctctggcttcaccgtcagtagcagctacatcgctacgtcgggtcccgcgaggccgtaccggaagggggacgggggtctagggaggtggggttctacgtaagtttactttactaactttcgtacggtaacccaactaacttaaacccgttaccgttccccggaaccccgtacgggtaaacggggtaccccgtaaacttaaacccgtacttaccctacccgaaggtaaacggtaaccggtaacgtttacccgggaaaaggttaaaacggtttaccggggtttacgttaacttaccgtttaaaccaaaagttaacggaaaacccctaaaccggtaggaacgggacgacccgtaacggaaaccgtacccgggtttaccttttaacgttaaccgtgggttagaccgggaaggtaaacgtcgtttacggggacgggtttcggggttacccgggggtcccttacccggttacccgttttacggggtttccctttaaaccggtttccgttaacggttcccggttccggggttccgggggttccccgtttcccggg

SEQ ID NO: 408866 - DNA, 587 bp, Homo sapiens
  misc_feature: GZ8MTXP01A241F.3.82.H05.1.454.CMB.2.raw
  modified_base (429)..(429): a, c, t, g, unknown or other
  modified_base (493)..(493): a, c, t, g, unknown or other
  modified_base (500)..(500): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcacgtcagtagcagctacatcgcacgtcgggtccgccgaggcctccggagggggaaggggctgggaggtgggtctcgtagttattacacttctggtaccacataactactcccgacccgtggaacgggccgtataaccatcctacagagacgatcccgagaaccncgggtatatcttacaaatagaaacacgtagagacgccgacgaccgacggtcgtttactacgtgngtcgagngtacgttcggaggttcgggtccggggtaccttccgacccgttggttaaccttacgttcgtactcggttcgtcgggggttccgtccgg

SEQ ID NO: 408867 - DNA, 681 bp, Homo sapiens
  misc_feature: GZ8MTXP01BCIJN.3.82.H05.1.454.CMB.2.raw
  modified_base (601)..(601): a, c, t, g, unknown or other
tcagagacgcactccacgaccggtgctcgatttagtcgagctctctcgcgggggggagatgagcccagcactgggattccgaggtgtttccattcggtgatcagcactgaacacagaggactcaccatggagttttggctgagcttgggttttccttgttgctatttcaaaaggtgtccagtgtgaggtgcaggtggtggagactgggaggaggcttgatccgagccgtgggggtccctgagctctcctgtgcagcctctggcttcaccgtcagtagcagctacatcgcacgtggggtcccgccgaggcctccgagggggaagggggctgggaggttcgggtctacgtaagtttactttaaccgaatttcgtacgggtaacccaactaaacttaacctaaccgtccccgaaaccccggtagggaaacgggcccgtaacttaaacccataccgtaccaaggaacgacgtacgttacccggaaagtaacgtacgggttatacttacttaacaaaattaccggaaacctaaaccgttaggaacgaaccgacccgaaccgtaccgtaccgggttaacccgttttataccgtggtacgcggtaagngttagttcggttaggtcgggttacgggaccttcgttacccgttggttctaacgttcgacttccgtcggttcggggtcccg

SEQ ID NO: 408868 - DNA, 846 bp, Homo sapiens
  misc_feature: GZ8MTXP01DSITK.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtggaggaggcttgatccagccgtgggggtccctgagactctcctgtgcacgcctctggcttcaaccgtcagtagcagctacatgcacgtgggtccgccaggcctaccggaagggggagggggctagggagtcgggtctcgtagttatttacaacttcgtaggtaacccacgtaacttaaaccgtaccctcccggtaacccccgtagggaaaaccggggtcccgtaaactttaaacccattccctacccgaagggtaacgaaccggtaagtttaccccggaaaggaaaacccgtacggggttagttaacttaccgtttaaaccaaaaagttacgggaaaaacccctaaacccggtttagggaaacggtaaaccgggtacccccgggaaaccggtaacccggtaaaccccggggtttaccccgttttttaaaagtttaccggttaacgggttccggggaaaccggtaacgggttaaagggttaacggttttacccgggggtaaagggttttcccggggggtttacccggggggtaacccctttaccccgttaaaccccggttttgggggttttaaccctaaaccgttttccggtaaccgtttccggttacccggggtttcggggggttcccggtttcccgggg

SEQ ID NO: 408869 - DNA, 555 bp, Homo sapiens
  misc_feature: GZ8MTXP01A46MW.3.82.H05.1.454.CMB.2.raw
  modified_base (273)..(273): a, c, t, g, unknown or other
  modified_base (383)..(383): a, c, t, g, unknown or other
  modified_base (428)..(428): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagtatggttagtctggtatcagcagaaaccagggaaacncccctgacgttcctgatgtctgctgcatccacctgacaaagtgacgtcccatccagattcagcgtcaagttgaatcgtagggacagagttcactctcacatcagcagccngcacgctagtaagtatttagactaacttactattacgtacaacgngactagactacgtcctcccgtcttcgtacggtttcgggacgggaacgggaaccgtaagggttacggaacgttaacgtaaccgaaaacggtaacgtacggtacggttacgtaaccgaacccgtaaccg

SEQ ID NO: 408870 - DNA, 710 bp, Homo sapiens
  misc_feature: GZ8MTXP01AUIPB.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtggggggtccctgagactctcctgtgcagcctctggcttcaccgtcagtagcagctacatgcacgtgggtcccgccaggcctccggaggggagggggcgtgggaggtgggtctcgtagttattactaattctaggtacccacgataaacctaccgtcccgaccccggtaggaaacgggtacccgtaattaaacccattacctacccgaagaacggaaccgatttacccggaaggtaaaccgtaccgggttagtacttaccttaacaaaagttcggaaaccctaaccggtaggaacgaaccggacccgaacggtaaccgaccggggtacccttttaagttaccgtggttacgaccgggtaaggaacggttacgttccgggtagggttcggggttacccgggggtaacccttcccgttaccccgtttggggtttaacccttaccgtttcggtacttccgttccgggttccgggggcccgttccggg

SEQ ID NO: 408871 - DNA, 623 bp, Homo sapiens
  misc_feature: GZ8MTXP01AS0JB.3.82.H05.1.454.CMB.2.raw
  modified_base (450)..(450): a, c, t, g, unknown or other
  modified_base (467)..(467): a, c, t, g, unknown or other
  modified_base (533)..(533): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagctctcctgtgcagcctctcggcttcaccgtcagtagcgagctacatcgcaccgtcgggtccgccgaggcgtccggaggggaacggggcgtgggaggtgggtctcgtagttatttactaacttctcggtaccacactaactacctcccgacccgtacggaacggtaccgtactaaccatacctaccgagacgtacgacttaccgagaaacncgggttatactcctaanaaatagaaaccaaccgtggaagaccgacccgaacgacgtacggttccctttaagtccgtgtgacgnggaaagtcgttcgggagttcggggttcccgggaaccttccgttccggttcggttctaccgttccgatccggttcgtcgggggcccgtcgg

SEQ ID NO: 408872 - DNA, 637 bp, Homo sapiens
  misc_feature: GZ8MTXP01DXZSD.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctggcttcaccgtcagtagcagctacatgcacgtcgggtccgccaggcctccgagggggaggggctgggagtgggtctcgtagttattacaattctagtaccacataacctactcccgacccgtaggaacgggcctaacttaaccatcctccaagacgacgattacccggaagtaaaccgtacggtagtaactcttaacaaattacgaaacctaaaccggtagaacgaacgacccgaacgtaaccgacggtacccgtttaataccgtgtaggccgaaggaagtagttccgggagggttcgggttaccgggggtacccttccggttcccgttagggtttcctacgttccgtactccgttcgggtccggggttccggtccgg

SEQ ID NO: 408873 - DNA, 694 bp, Homo sapiens
  misc_feature: GZ8MTXP01BW8AJ.3.82.H05.1.454.CMB.2.raw
  modified_base (602)..(602): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttactatttacaaaaggtgtccagtgtgaggtgcgaggtggtggagacgtgggaggaggcttgatccgagccgtggggggtccctggagactctcctgtgcacgcctctggcttcaccgtcagtagcagctacatcgcacgtcgggtcccgcgacggccgtaccggagggggaaggggcgtgggaggtgggtctacgtagtttactttaccaagtttcgtacggtaacccacgtaaacttaaccctaacccgtaccccggtaaccccggttaggtaaccgggttacccgtaaacttaaacccgacttacccgtacgaaggtacgtaccgtaacttacccggaaagtaaaccgtacgggttacttaactacttaaacaaagttacgaaaccgtaaccgtggaacgtacgacccgaacgtaccgtacggttacctttataccgngtcgacgtaaggagttgttcggaggttcgggttccgggacccttcgacccgtttggtccttaacgtcgacgttccgtcggttcggggtcccg

SEQ ID NO: 408874 - DNA, 594 bp, Homo sapiens
  misc_feature: GZ8MTXP01CV6N7.3.82.H05.1.454.CMB.2.raw
  modified_base (240)..(240): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatcgtggtaggggacagagtcgctatgacttggtcgggcgactcgtacggttttaacngtattggttagtctggtatcgagacaagaaaaccgagggaaacgccccgtagtacgttccgtgatcgtctgctgcactcccaccgtgacgaaagtggactaccatccgaagtacttacgagtccgtactaagtacgtaagtcggtagggaaactaggtacttcactcctcaactatacgagcacgtcctacgcacggaccttagaattatttcgacttaaacttacttaagttcgtaacaagacgtactacgactacgtccctcccggtcttccgtacgtttcggggacgggaacggtaaccgaagggttacgacgaactaacgaaaacgtgtggacggttctaacgcctaacg

SEQ ID NO: 408875 - DNA, 680 bp, Homo sapiens
  misc_feature: GZ8MTXP01DWUTW.3.82.H05.1.454.CMB.2.raw
  modified_base (456)..(456): a, c, t, g, unknown or other
  modified_base (467)..(467): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtgggaggaggcttgatccgagccgtgggggtccctgagactctcctgtgcagcctctggcttcgaccgtcagtagcagctacatcgctacgtcgggtccgccgaggccgtaccggagggggaacggggcgtgggaggtcgggtctacgtagttatttaactaacttcgtacgtaccactactaacctaccgtcccgacccgtaggaacgggacctaactaaccatctaccaagacgacgacttacggaaanaacgtacggtntaactacttaacaaactacgaaacctaacggtaggaacggtacaccgacgaacctccgggttaccttttaatcgtgtacggacgaggtaagtcgttacgggtagggttcggggttaccccggggtaacccttcccgttaacccggttcggtttaacccgttaaccgttccgtaacgggttcccgttccggggtcggggggttcccgtccgggg

SEQ ID NO: 408876 - DNA, 600 bp, Homo sapiens
  misc_feature: GZ8MTXP01CJ6O4.3.82.H05.1.454.CMB.2.raw
  modified_base (251)..(251): a, c, t, g, unknown or other
  modified_base (360)..(360): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtncagcctctggcttcaccgtcagtagcagctacatgcacgtcgggtcccgccgaggcctaccggagggggacggggcgtgggaggtgggtctgtagtttatttacattcnggtaccactactaactacctccgacccgtagaacgggccataccatctaccagacgacgtactccgaagaacgtacgtgtaactcgttaacaaaagtcgaaaccaacgtgaagacggaccgaacgaccgacggtacgttttatccgtaggtcgacgagaagtagttcggaggttcgggttccggggaccttccgttcccgttggttcctacttcggactccgttcggttcgggccgtcgg

SEQ ID NO: 408877 - DNA, 595 bp, Homo sapiens
  misc_feature: GZ8MTXP01C6CR5.3.82.H05.1.454.CMB.2.raw
  modified_base (365)..(365): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttggtcgggcgactcggtacggttttaaacagtattgggttagtcgtggtatcgagacaagaaaccgagggaaacgcccctggacgttcctgatgtctgctgcactcccacctgacgaagtcggacgtcccatccagtattcagtcgtcaagtanaagtcgtagggacagtacgttcactctccacatcagcacgcctgcacgccgtagtaagttattttcgaacttaaactttacttaattacgtaaccaaacgtaggtctacgtacctacgttccctccccgtctccgttaccggtttccgggggacggaacgggggtaaccgaaggggttcggaagttaactaaccgaaaacggtcgtagggcggttactcgaaccctaacc

SEQ ID NO: 408878 - DNA, 659 bp, Homo sapiens
  misc_feature: GZ8MTXP01BYUMS.3.82.H05.1.454.CMB.2.raw
  modified_base (298)..(298): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtgggtccnccaggctccgaggggagggctgggaggtgggtctcgtagttacttacaacttcgtaggtaccacataacctacctcccggacccgtggaacgggccattaaccatcctccaagacgacgtacttccggaagaaaccgtacgggttatactccttaacaaaagttacgaaaccaaccggttaggaacgacgacccggaacgacccacgggttccgttttaataccgtggtcgtaccgaggaacgtagttcgggaacggttcggggtttcccgggggaacccttcccggttaaccccgtttggggtttaaccttacccgttcggtacgttccgttccggttcggggggaaccccgttccgggg

SEQ ID NO: 408879 - DNA, 647 bp, Homo sapiens
  misc_feature: GZ8MTXP01AQA2S.3.82.H05.1.454.CMB.2.raw
  modified_base (563)..(563): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccgagccgtgggggtcctgagactctcctgtgcacgcctctggtcttcaccgtcagtagcagctacatcgctacgtcgggtcccgccgaggcctccggaagggggacggggcgtgggagtcggggtcttcgtagtttactttactaactttcgtacggtaacccactaacttaaccctacctcccggaccccgtaggaacgggcctaattaacccatcctaccaagacgaaccgtacgttaccgaagtaaacgtacgggttattacgtacttaacgaaaatacgaaaccaaccgtagacggacgaccgaacgaccgacggttacgttatacgtgtcgcgaagngtgttcggaggttcgggtaccgggtaccttccgttcccgttggttcctacgtcgtacgtccggttcggtcggggttccgtcggg

SEQ ID NO: 408880 - DNA, 587 bp, Homo sapiens
  misc_feature: GZ8MTXP01A9Y92.3.82.H05.1.454.CMB.2.raw
  modified_base (448)..(448): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtcccgccaggcctccggaagggggaacgggggctgggagtggggtctcgtagtttatttacaacttctaggtaccactataacctacctcccgacccgtggaaacgggcctaattaaccatcctaccagacgacgattaccgagaacacggttntactcttacaaatgaaacacgtgagacgccgacgacgacggtctttatacgtgtagcgagaacgtgttcggaggttcgggtccgggacttccgttaccgttggttcctacgtcgtactccgttcggtcggggccgtcgg

SEQ ID NO: 408881 - DNA, 563 bp, Homo sapiens
  misc_feature: GZ8MTXP01AKX9V.3.82.H05.1.454.CMB.2.raw
  modified_base (388)..(388): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccgccaggctccgaggggaaggggctgggagtgggtctcagttattacaattctggtaccacataactactcccgacccgtgaagggccattaaccntctccagagacgattccgagaacacggtgtatcttacaaatgaacacgtgagacgaccgacgacacggtccgtttaattacctgtgcgagaagtattcggaggttcgggttccggggacccttcgacccgttgggtttcctacgttccgattccgttcggtcggggcccgtcggg

SEQ ID NO: 408882 - DNA, 722 bp, Homo sapiens
  misc_feature: GZ8MTXP01BTZNL.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctggcttcaccgtcagtagcagctacatgcacgtcgggtcccgccgaggcctccgagggggaagggggctgggaggtgggtctcgtagtttatttacaacttctaggtaccacataacctacctcccgacccgtaggaacgggaccgtaattaaccatcctaccagacgacgtattacccgaagaaaccgtacgggttattactaccttaacaaaagttacgaaaaccaaaccggttaggaaacggaaccggacccgggaaaccggtaacccgaaccggggttacccgtttttaaagttaacccgttgggttacgaccgggaaggtaacggtaacgttttaccggggaaggggtttcggggttacccggggggtaacccctttaccggttaccccgtttcggggtttaacctaacccgtttcggtaacttccggttccggggttcgggggttcccgggttccggg

SEQ ID NO: 408883 - DNA, 688 bp, Homo sapiens
  misc_feature: GZ8MTXP01AF02K.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtcgggtcccgccgaggcctacccggagggggaacgggggcgtgggaggtgggtctcgtagtttactttacattcgtacggtaccaacataacctacctcccgacccgtaggaacgggccgaaacttaacccacgtcctacccgaaggacgaacgtacgttaccccgaagtaacaccgggttgtaacttaccgtttacaaaaagttcggggaaaaccctaaccgttggaaacggaaccgacccggtaaccggaaccgtaacccggggtccgtttttaaagtaccgtggttacgaaccggaaggttagtacgtttccggaagggttcggggttcccggggacccttccggtaacccgtttgggttccttacgttcggcttccggttccgtccgggggg

SEQ ID NO: 408884 - DNA, 847 bp, Homo sapiens
  misc_feature: GZ8MTXP01ED348.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatcgcacgtcgggtcccgccgaggcctaccggaagggggaagggggccgtggggaggttcgggggtcttacgtaaggtttaatttaacgtaaacgtttccgtacggtaacccactaacttaaacccttacccgttccccgggtaacccccgtagggaaaccggggtacccgtaaactttaaaccccattacccttacccgaaggtaacgtaaccggaactttacccggaaagtaaaaccgtaccgggttagttaacttactttaaaccaaaattacggaaaacctaaacccgggttaggaacggtaaacggttcccggaaaccggtaacccgtaacccggggtttacccgtttttaaacgtttaaccgttagggttacggtacccgggaaagggtaagggttaaacgttttaccgggggtaaacgggttttcggggggtttaccccggggggtaacccctttaccccggttaaccccggttttcgggggttttccctttaaacgtttccgggttaaacgttcccggttccggggtttccgggggggttccccggtttcccggggg

SEQ ID NO: 408885 - DNA, 697 bp, Homo sapiens
  misc_feature: GZ8MTXP01ELDW7.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtggaggaggcttgatccgagccgtgggggtccctgagactctcctgtgcagcctctggctcacgtcagtagcagctacatgcacgtgggtccgccaggctccgaggggaagggctgggagttgggtctcgtagttacttactaacttctaggtaccactactaaacctacctcccggaccccgtagggaaacgggaccgtaacttaaccgatcctaccgaagacgtacgacgttaccggaagaaaccgtacgggttataactacttaacaaagttacgaaacctaaaccgttggaacggaaccggacccgaacgaaaccgtaccgggttaccccgttttaaagttaccgttgttacggtaaccggaggtaaaggtaacggtttccgggaaaggggtttcgggggttacccgggggaaaccccttcccgttaccccgttgggtttcccttaacgttcggtaacttcgttccgggttcgggggccccgttccggg

SEQ ID NO: 408886 - DNA, 738 bp, Homo sapiens
  misc_feature: GZ8MTXP01BCZGU.3.82.H05.1.454.CMB.2.raw
  modified_base (274)..(274): a, c, t, g, unknown or other
  modified_base (303)..(303): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccgagccgtggggggtccctgagactctcctgtgcagcctcgtggcttcgaccgtnagtagcagctacatgcacgtcgggtcccnccgaggcctaccggagggggaacgggggtcgtaggggaggttggggtctacgttagtttaactttactaactttccgaggtaacccactaacttaaaccctacccgtcccggacccccggtagggaaaccggggtccctaaacgtttaacccacttccctacccgaaggaacgtaaccggtaacgttacccggaaagtaaaccgtacgggttagttacttacctttaaacaaaagttaccgaaaaccctaaccggtaggaaacggacgaccccggaaacgtaaccgtacccgggttaccgtttttaaagttaccgtgggttacggacgtaaaggtaagttaaacgtttcgggagggtttccggggttacccgggaccttcccgcccgtttggttaaccctacgttcgacgttccgttcggtcggggcccgttcgg

SEQ ID NO: 408887 - DNA, 593 bp, Homo sapiens
  misc_feature: GZ8MTXP01CIKZ5.3.82.H05.1.454.CMB.2.raw
  modified_base (446)..(446): a, c, t, g, unknown or other
  modified_base (511)..(511): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctggcttcaccgtcagtagcagctacatgcacgtgggtcccgccaggcctccgaagggggaggggctgggagtgggtctacgtagttatttacaacttctggtaccactactaacctaccgtcccgacccgtggaaacgggcctaacttaaccatctaccgagacgacgattaccgagaacgtacggtntatcttacaaatcgaaacacgtgagacgaccgacgacacggtctttatacgtgtgacgagaagtnttcggagttcggggttccggggccttccggccccgtttgggttaaccttacgttcgtactcgttcggtcggggttccgtcgg

SEQ ID NO: 408888 - DNA, 619 bp, Homo sapiens
  misc_feature: GZ8MTXP01D22VY.3.82.H05.1.454.CMB.2.raw
  modified_base (434)..(434): a, c, t, g, unknown or other
  modified_base (514)..(514): a, c, t, g, unknown or other
  modified_base (604)..(604): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatcgtggtaggggacagagtcgctatgtacgttgtcgggcgtactcggtacggttttaacagtagttggttagtctaggtactcgagacgaaacgaaaccggagggaaaccgccccgtaggtacgttcctggtatgtctgctgacactccgacctgaaccgtaagtcggactacccactaccgagtacttacgaagtccgtagaagttagaacgtcggtagggacctagtacgttcaacttccacaacctancgacgctacgtcacgacacggtacttaagtaagtttacgtttaccgaactttaaactttagttaacgtacgaacgaacgngtactacgactccgtccgtcctcgtcgttacggttcggggaacggacggaacggtaaggttacgacgttaacgtaaccgaagtcgtcggngttactcgccgtaag

SEQ ID NO: 408889 - DNA, 580 bp, Homo sapiens
  misc_feature: GZ8MTXP01CFY6D.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgctacgtgggtcccgccaggcctccgagggggaggggctgggagtgggtctcgtagttatttacaacttctgtaccactataaccttacctcccgacccgtggaacgggccgattaacccatcctccaagacgacgattcccgagaacacggtatactctacaaatgaaccacgtgagacgaccgacgacgaccggtccgtttatacgtgtgtcgaggaagtgttcggagttcgggttccggggcttccgttcccgttcgttcctacgttcgtatcgttcgttcgggggccctcggg

SEQ ID NO: 408890 - DNA, 644 bp, Homo sapiens
  misc_feature: GZ8MTXP01AZLAY.3.82.H05.1.454.CMB.2.raw
  modified_base (444)..(444): a, c, t, g, unknown or other
  modified_base (491)..(491): a, c, t, g, unknown or other
  modified_base (502)..(502): a, c, t, g, unknown or other
  modified_base (561)..(561): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtggaggaggcttgatccagccgtgggggtccctgagactctcctgtgcagcctctggcttcaccgtcagtagcagctacatgcacgtcggtccgccgaggctccggagggggaacggggcgtgggaggttcgggtctacgtagtttaactttacaatttcgtcggtaacccaaactacttaacctacctacccgggaaccccgttagggaaccggggtacccgtaattaaaccccgnttccaccaaggacgaacgtaacgttacccgaaagtaaccacgggttntaattacctanaaaactcggaaacaccgtgaacgacgaccgacgaacgtacggtaccgtttatacgtggngaacgagagtacgttggaacgttcgggttaaccgggcttaccggtaaccctggtttccacgttcacgttcgttcgggtcgggg

SEQ ID NO: 408891 - DNA, 574 bp, Homo sapiens
  misc_feature: GZ8MTXP01C5AXH.3.82.H05.1.454.CMB.2.raw
  modified_base (470)..(470): a, c, t, g, unknown or other
  modified_base (488)..(488): a, c, t, g, unknown or other
  modified_base (495)..(495): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatcgtggtaggggacagagtcgctatgacttggcgggcgtactcggtacggttttaacagtagttgggttagtcgtgggtatcgagacaagaaaccgagggaaacgcccccgtggtacgttcctgatgtctgctgccactcccaccctgacgaaaggtcggacgtcccatccagtattcgagcgtcaaagtgaagtcgtaggggaactaggtacgttcactcctacacctatcgagcacgcctgacacgcctagaagttatttagacttaacttacttattgacaagnggactagactccggtccnccccgtntccgtacggtttcggggacggacgggtaccgaagggttgagacgtaacgaaacgtcgttaggcgttactcgcctaaccg

SEQ ID NO: 408892 - DNA, 637 bp, Homo sapiens
  misc_feature: GZ8MTXP01AYNVI.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagccctctggcttcaccgtcagtagcagctacatgcacgtgggtccgcgaggctccgaggggaagggctgggagtgggtctcgagtttacttacaattcgtaggtacccaactaactcctaaccgtcccgaacccccggttggaaacggggtcccgtaatttaaacccattacctaccgaacgtacggaccgtacttacccggaaggaaacctaccgggttagttacttacgttaacaaaattcggggaaaccaacccgtggaacgacgcccgaacggactaccgggtaccgtttataccgtgtcgcgtaagacgtagttcgaaggtcggggttcggggcccttcgaacccgttggttcctacttcgactccgttgtccggggg

SEQ ID NO: 408893 - DNA, 687 bp, Homo sapiens
  misc_feature: GZ8MTXP01B7UTZ.3.82.H05.1.454.CMB.2.raw
  modified_base (665)..(665): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctattcaaaggtgtccagtgtgaggtgcaggtggtggagactgggaggaggcttgatccagccgtgggggtcctgagactctcctgtgcagcctctcggtcttcaccgtcagtacgcacgctacatcgctacgtcgggtccgccgacggctaccggaagggggacgggggcgtgggtaggtcgggtctacgtagtttatttacgtaacttcgtacggtaaccactacttaaaccctacccgtccccggtaccccggtagggaaacgggtacccgtaacttaacccgactacccgtaccaaggaccggtaaccgtacgttacccggaaacgtaaaccggtcgggtttacgttaacttaccttaaaccaaaagttccgaaaaacctacccgttaggggaacgtaccgacccggaaactaccgaccggttactttacgtactgggtacgcgtagaacgttgttcgggaggttcgggtccggaccttcgccgttcggttaactgtccgnttccgttgggtcggggccgtcg

SEQ ID NO: 408894 - DNA, 584 bp, Homo sapiens
  misc_feature: GZ8MTXP01CWMPZ.3.82.H05.1.454.CMB.2.raw
  modified_base (277)..(277): a, c, t, g, unknown or other
  modified_base (477)..(477): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttgtcgggcactcgtacggttttaacagtatggttagtctggtatcagcaagaaaccgagggaaacncccctaggacgttcctgatgtctgctgcaactccaccctgacaaaggtcgacgtacccatccgagtacttacgagtccgtacgaaagttgaacgttcgtaggggactagtacgttccaactcctacacctactacacgcacgctacggcacgccgttagaagttatttcgaacttaactttacttagttacgactaacgnggtacttacggactaccgtcctcccgtctcgtaacggttcgggacggacgggaaccgtagggttacgagacgtaacgaaacgtaactggtcggactcgaacctaacg

SEQ ID NO: 408895 - DNA, 954 bp, Homo sapiens
  misc_feature: GZ8MTXP01A8S3M.3.82.H05.1.454.CMB.2.raw
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatcgtggtaggggacaggagtcgctatgtacttggcgggcgtacgtcggtacggttttaacagtagttgggttagtcttgggtatcgaagacaaacggaaaacccgaggggaaaaccgtccccccgttaggtaacgtttcccgtaggtaacgtttcggttccgtcggtccttacggacccctaacgttaccccccgaacccccggttaggaaacccgtaaaaggggttccgggggtaaacccgttaccccccaaagttacccccgtaaaggtaacgttttaccgaacgggtacccggtttaccgtaaaagggttacgggtaaacgtttccgggttaacggggggaaaccctaaacggggttaaccggttttacccctaaacccgtttacccctttaaccccaaaccccgtaaacttacccgaaaccgggccctaaacccggtccccgtacggttacccgaacggttaccccgttaagggttaaacgtttaactttttaccgggaaaccctttaaaaccgtttttaactttaacgtttaaccggttaaaccaaaaccggtacggttaccgttaaccggtaaccgttaaccggtttcccccgttacccccggtcgtttaacccggttaaaccccgggttttccggggggaaaccgggggttaaaccgggggtaaacccggtaaagggggttacgggttaaacggttaaaccgtaaaccgggtaaaaaccggtcggttcgggtacggttaccgtaacggttaacccttaaacccg

SEQ ID NO: 408896 - DNA, 778 bp, Homo sapiens
  misc_feature: GZ8MTXP01BFOVM.3.82.H05.1.454.CMB.2.raw
  modified_base (522)..(522): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccgagccgtgggggtccctgagactctcctgtgcagcctcgtggcttcaccgtcagtagcagctacatgcctacgtcgggtccgccgaggcctccggaagggggaacggggcgtggggaggttcggggttcctacgtaaggtttaatttactaactttccgtacggtaacccactaacttaaacccgtaccgtccccggaacccgggtagggaaaccggggtaccctaacttaacccgtactacccgtacccgaggtaacggaaccgtacgtttacccggaaaggtaaaccgttacggggttntaaacgttaccttaaacgaaaacgttacggaaaaacctaacccggggtaagggaacccggaaaccggtaccccggaaacggtaaccgtaccccggggtttaccgtttaaatttccgtgggttacgaaccgtagggtaaacgtcgtttacgggtaaagggtttccggggttaaccggggaaccctttcccggttcccgtttagggttaaccctacggttcgtacgtcccgttcgggtcgggggttcccgtaaccggg

SEQ ID NO: 408897 - DNA, 611 bp, Homo sapiens
  misc_feature: GZ8MTXP01DEZGJ.3.82.H05.1.454.CMB.2.raw
  modified_base (258)..(258): a, c, t, g, unknown or other
  modified_base (428)..(428): a, c, t, g, unknown or other
  modified_base (467)..(467): a, c, t, g, unknown or other
  modified_base (529)..(529): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgcttatttcaaaaggtgtccagtgtgaggtgcaggtggtggagactgggaggaggcttgatccagccgtggggggtccctgagactctcctgtgcngcctctggcttcaccgtcagtagcagctacatgcacgtcggtccgccgaggctccggaagggggacggggctgggaggtcgggtctcgtagttttaacttactaattcgtacggtacccaaactacttaactaccctcccggacccgtaggaaacgggcctaactaaccntctaccaggacgacgtacgttaccgaagaactacgggtnttactcttaacaaatcgggaaacacgtagacgacgccgacgactaccggtccgtttatacgngtgaacgtagagtagttcggaggttcgggttacggccttcgcccgtttggtaacttcgttacgcttccgttgggtaaccggg

SEQ ID NO: 408898 - DNA, 712 bp, Homo sapiens
  misc_feature: GZ8MTXP01D7SJ7.3.82.H05.1.454.CMB.2.raw
  modified_base (278)..(278): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagactggaggaggcttgatccagccgtgggggtcctgagactctcctgtgcacgtcctcgtggcttcaccgtcagtancagactacatcgcgacgtcgggtccgccgagggcctaccggaagggggaacgggggcgtggggtacggtggggtcttacgtagtttaactttactaacttccgtaggtaccactactaaccctacctcccggacccgtagggaaacccgggtccgtaactttaaacccacgttaccctacccgaaggtaaccggtaacgtacttaccggaaagtaaaccgtacggggtttactaacttaccgttaaaccaaattaacggaaacccaaccggttaggaacggaaccgccgtaaacgacccgtaccggttaccgtttaattacgtcggtacgacggagtaaagtcgttggggtaacgggtttcgggtacccggggtccttccgttcccgttcggttaacttacgttcgactcgttcggtcgggggttccctccggg

SEQ ID NO: 408899 - DNA, 570 bp, Homo sapiens
  misc_feature: GZ8MTXP01BBLD2.3.82.H05.1.454.CMB.2.raw
  modified_base (298)..(298): a, c, t, g, unknown or other
  modified_base (352)..(352): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcacgtgggtcccnccaggctccgagggggaggggctgggagtgggtctcgagttatttacaacttcnggtaccacataacctacctcccgaccccgtgaacgggccgaattaaccatctaccagacgacgattccgaagaacgacggtgtactacttacaaatcgaaacaacgtgagacgccgacgacgacggtccgtttataccgtgtgcgagaagattcggaggttcgggtcggggaccttcgaccttggttcctacttcgatcgttcgtcggggcccgtcgg

SEQ ID NO: 408900 - DNA, 810 bp, Homo sapiens
  misc_feature: GZ8MTXP01D4NY9.3.82.H05.1.454.CMB.2.raw
  modified_base (275)..(275): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagactggaggaggcttgatccagccgtgggggtcctgagactctcctgtcgcagcctcgtggcttcaccgtnagtagcagctacatcgccacgtcgggtccgccgaggtctaccggaagggggaacggggtctggggacggttcgggttctacgtaagtttacctttaactaaacgtttccgtacggtaacccaaacgttaacttaacccgtaccgtaccccgggtaccccgggttaaggaaaccggggtacccgtaaactttaaacccacgttcctaccgaaaggaacgtaccgtaacgtttaccccggaagttaaaccgtaccgggttattaaacttaccctttaaacgaaagttaccggggtaaaaccctaaacccggttggaaaccggtaccggaccccggtaaaccggtacccggttaaacccgggttcccgtttttaaagtccgttacgggtacggaaccggtaaggttaacggtttaacgttccgggtaaagggtttcccgggggttaaaccccggggttccttaccccgttaacccggtttcgggtttaaccctttacggtacccgggttactttccgggttaaccggggtcccggggg

SEQ ID NO: 408901 - DNA, 613 bp, Homo sapiens
  misc_feature: GZ8MTXP01CG0Q1.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtcccgccgaggctccgagggggaagggggctgggagtgggtctcgtagttatttacaacttctaggtaccacactaacctacctcccgaccccgtaggaaacgggccgtaactaaccatcctaccaagacgacgattacccgaagtaaccgtacggtgtaactcttacaaatcgaaacaaccggtagaacgacgaccccggaagtaacccgaccggtaccgttttaagtacctggtcgcgaaggaagtacttcggagttcgggtaccggggtccttccgacccgttggttctacttcgatcgttcgtcggttcggtcccg

SEQ ID NO: 408902 - DNA, 568 bp, Homo sapiens
  misc_feature: GZ8MTXP01CEQ1H.3.82.H05.1.454.CMB.2.raw
  modified_base (403)..(403): a, c, t, g, unknown or other
  modified_base (440)..(440): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtgggtccgccaggctccgagggggaaggggctgggagtgggtctcgtagtttactttacatttctggtaccaacataactactcccgacccgtgaacgggccattaacccntctccagagacgattaccgagaacacggtgtatctanaaatgaacaacgtgagacgccgagactacgggtcctttatactgtgaacgtagagtagttcggtaggtgggttccggggccttcgaacccgttgggttccttacgtcgacgttcgttcgggtcggggg

SEQ ID NO: 408903 - DNA, 692 bp, Homo sapiens
  misc_feature: GZ8MTXP01BQNZ2.3.82.H05.1.454.CMB.2.raw
  modified_base (637)..(637): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtggaggaggcttgatccgagccgtgggggtccctgagactctcctgtgcacgcctgtggtattctacctttgatgtattatgaccagtcgccgaaccggtccggtccgacgacgccgtacgggaaggggaccggtcggtagggtgggttcgtacgtagtaaggttacgttaggtaagtagtagtactaataacgtacgtcctgtagtacgggtcgtacttgtacgggtagggaccgtcgtactaccaactctacccgaagaacggaaccgaaaccgaacccgaaacgtaaacctacccgttacgttacgtactacgtaacgtaaacgtaacgtaataacccgttgtagtaaacggaccgtacggacggtaaccggtaaccgtcgggtctttacgttaagttacgttacgggtaaggttaacccggggttanaagtttaacgtagttaacgtttaaggttacttactttaacgttaacgtttaacgg

SEQ ID NO: 408904 - DNA, 683 bp, Homo sapiens
  misc_feature: GZ8MTXP01A7H77.3.82.H05.1.454.CMB.2.raw
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgtacgttggtcgggcgtacgtcggtacggttttaacaggtagttggttagtcgtggtatcgagacaaggaaaccgagggaaacgccccgtaggtacgttcctgattgtctgctgctactcccacctgacaaagtggactcccatccgagtactcgagtacgtacaaggtagtaaacgtcgtacggggaactaggtacgtttccactcctaccacactcgaagccacgtcccgagtacgacgtaccgtaagtaaacgtttacgttttacgaaccgtttaaactttaccgttaagttacgtaaccgtaaacggtacgtcgtacgtaaccgtccgtcccgttaacccggtccttacccggttaccggtttacccgggggaacgggggtaaccgggttaaccggttaaaggggttcggaaagtaaccgtaaacggtaaaacggtaccggttacgggtccggttaacgttaacccgg

SEQ ID NO: 408905 - DNA, 758 bp, Homo sapiens
  misc_feature: GZ8MTXP01BQDQK.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagtcttgggttttccttgttgctatttacaaaaggtgtccagtgtgaggtgcaggtggtggagacgtggaggaggcttgatccgaggtccggtgggggtccctggagtactctccgtgtgcacgtcctcgtcggtcttccaccgtcagtacgcagctacatcgctacgtcggggtcccgccgacggccgtaccggaagggggaacgggggtcgtagggtcggtgggtcttacgttaaggtttactttaactaactttcgtacggtaacctaactacttaaaccctacccgtcccggaacccgtacgggaaacgggtaccctaacttaaaccgctaccctaccgaagacgtacgtacgtaaccgaagtaaccgtacggttacgttaacttaccgttaaactaaaacgttacgaaaaccctaaacggtaggaaacggaccggaaccggaaacccggtacgtaaccccgggttacgttttaaacgttacgtacggttacggacgtaacgggtaagtacgtttagggtacgggttcggggttacccggtaccgttaccgttcccggttcggtttaacctacgttcgtacttccggttcgggtaacgggttccgtaaccggg

SEQ ID NO: 408906 - DNA, 759 bp, Homo sapiens
  misc_feature: GZ8MTXP01CGS1C.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactgggaggaggctgatccagccgtgggggtccctgagactctcctgtgcacgcctctggcttcaccgtcagtagcagctacatgcacgtcgggtccgccaggcctccggaaggggagggggctgggaggtcgggtctcgtaagttatttaacaactttccgtggtaccctacactaacctaccctcccggaccccgtagggaaccgggtccgtaacttaaacccacttaccgtaccaacggaacggaacgtaacgttacccggaaacggaaacgtaaccgggtttacgttaacttaccgtttaaacaaaagtaccgtaaaacccgtaaaccgggttacggaaacggtaaaccggaccccggaaaccgtaaacccggtaaccgggtttaccccgttttaaagtttacccgtagggttacggtaccgggtaagtaacgggtaaacgtttcgggtaaagggtttcgggggttaaccgggtcccgttacccgttacccgttcgggtttccttacgtttccgtacgttccgttacgggttccgggggttaacccgttccggg

SEQ ID NO: 408907 - DNA, 627 bp, Homo sapiens
  misc_feature: GZ8MTXP01BZPUC.3.82.H05.1.454.CMB.2.raw
  modified_base (430)..(430): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttacaaaaggtgtccagtgtgaggtgcgaggtggtggagacgtggaggaggcttgatccgagccgtgggggtccctgagctctcctgtgcagcctcgtcggcttcaccgtcagtagcagctacatgcacgtcgggtccgccgaggctaccggagggggaaggggcgtgggagtgggtctgtagttacttacattctaggtaccaacgactctacctccgacccgtcgaacggcgaataccatctaccagacgacgataccganactacggtatactctacaaatacgggaaactaaaccgtagaacgacgaccgaacgaccgaacggttccgttaatacgtgtggaacgaagttagtacgttcgggtaacgggttcggggttaccgggggttcccttaccggtaacccgtttcgggtttcctttaccggtacttacggttccgttcgggtttcccggggg

SEQ ID NO: 408908 - DNA, 747 bp, Homo sapiens
  misc_feature: GZ8MTXP01CSH1H.3.82.H05.1.454.CMB.2.raw
  modified_base (281)..(281): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtggaggaggcttgatccagccgtgggggtccctgagactctcctgtgcagcctcgtcggcttcgaccgtcagtancagctacatcgcacgtcgggtcccgccgaggcctaccggaagggggacggggcgtagggaggtgggtctacgtagtttatttaacaactttcgtacggtaccactactaacctacctccgacccgtggaaacgggcccaattaaccactctaccagaacggacgtagttacccgaaagtaacgtaccggttagtaacttaccttaacgaaaacgttacgaaaacccgtaacccggttaggaaacgggaacgaccccgggaaacgtaacccgtaaccgggtttaccgttttaaacgttacggtagttacggacggtaaaggtaacgttaacggtttcgggtaaacgggtttccgggggttaaaccgggggtacccctttaccggttaccccgttttggggtttaaccctttaaccgtttccggtacgttccgggttccgggttccggggggttaacccggttcccgg

SEQ ID NO: 408909 - DNA, 581 bp, Homo sapiens
  misc_feature: GZ8MTXP01BZSR0.3.82.H05.1.454.CMB.2.raw
  modified_base (239)..(239): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctggtagggacagagtcgctatgacttggtcgggcactcggtacggttttaaacngtagttggttagtctggtatcagacaagaaaccgagggaaacgccctagacgttcctgatgtctgctgcactcccacctgacaaggtcgactcccatccagtacttcgagtccgtacaagtagaagtcgtagggacagtacgttcactctacaccactcagcacgccctgacacgcctaagtaagttactttcgaacttaactttacgtattacgtaacaaacgtggactacggacctacggttccctccccgtcttaaccgtcggtttccggggacgggttaacggaaccgtagggttacgacgactaacgaaacgtcgtaggtcgacctcgaacctaacg

SEQ ID NO: 408910 - DNA, 643 bp, Homo sapiens
  misc_feature: GZ8MTXP01ER3NZ.3.82.H05.1.454.CMB.2.raw
  modified_base (256)..(256): a, c, t, g, unknown or other
  modified_base (427)..(427): a, c, t, g, unknown or other
  modified_base (467)..(467): a, c, t, g, unknown or other
  modified_base (617)..(617): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtggaggaggcttgatccgagccgtgggggtccctgagactctcctgtgcngcctcgtggcttcaccgtcagtagcagctacatcgcacgtgggtcccgccgaggcctaccggaagggggaacgggggcgtgggtaggttcgggtctacgtagtttaatttactaacttcgtacgtaccactactaacctacctcccgacccgtgaacgggctaactaaccntcacgagacgacgtacttaccgaagtaaccgtagggtttntaactacctaacgaaaacgtacgaaacctaacgggtagaaccgaccgacccgaacgaacccgtacggttacgtttaatcgtgcgacgagtaagtacggttcggaggttccgggtaccgacccttcgttcccgttgttaacctacgttcgngttcggttccgggtcgggttccgtcg

SEQ ID NO: 408911 - DNA, 752 bp, Homo sapiens
  misc_feature: GZ8MTXP01EUBY8.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtgggaggaggcttgatccgacgccgtcgggggtcctgacgctctcctgtgcacgcctcgtcggtccttacgaccgtcagtagcagctacatcgctacgtcgggtcccgccgaggcgtaccggaagggggacgggggcgtggggaggttcgggtacttacgtaagtttatttactaacgttcgtacggtaacccactacctaacctaccgtcccggtacccgtagggaaccgggtccgtaaacttaaccacttactacccgaagtacgaacgtacgttacccggaaagtaaaccgttacggggtttactaacgttaccttaaaacgaaagttaaccggaaaaccctaaacccggggttaggaaaccggggtaaccgaccccggaaacgggtaacccgtacccggggtttacttttaacgtacgttggacggacggtaggaacgttacgttccggggagggtttccgggggttaccgggacccttccggttaccgttcgggttaaccttcgttcgtacgtccgggttcggtccgggggttccgtccggg

SEQ ID NO: 408912 - DNA, 685 bp, Homo sapiens
  misc_feature: GZ8MTXP01ENKVH.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaggtgtccagtgtgaggtgcgaggtggtggagacgtggaggaggcttgatccgagccgtggggggtccctgagactctcctgtgcagcctctggcttcaccgtcagtagcagctacatgcacgtcggtccgcgaggctccgagggggaaggggcgtgggaggttgggtctacgtagtttactttactaattcgtacggtacccaaacgtaacttaaccgtaccgtccccggaacccccgggttaggaaaccgggggtacccgtaaactttaaacccacttacctaccgaaggacgaaccggtacgtttacccggaaagtaaaccgtacgggttacgttaactaccttaaacaaacgttacgggaaacctaaccgtaggaacggacgacccgacgaacgtaccggtaccgtttaatacgtgtgcgagagtacgttcggtaggttcgggttaccggggcccttccgtaaccccggttggttaaccttacgttcgacgttccgttcggtccggggg

SEQ ID NO: 408913 - DNA, 659 bp, Homo sapiens
  misc_feature: GZ8MTXP01AT5MZ.3.82.H05.1.454.CMB.2.raw
  modified_base (290)..(290): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtggaggaggcttgatccgaggccgtgggggtccctgagactctcctgtgcagcctctcggcttcgaccgtcagtagcagctacntgcctacgtcgggtcccgccgaggcgtaccggagggggaacggggcgtggggaggtgggtctacgtagtttattactacttcgtacggtacccactactaacctaccgtcccgacccgtaggaacgggccgtaacttaacccatcctaccgaagaacgacgtacttaccggaagtaaaccgtcggttagttaactacttaacgaaatacgaaacctaacggtaggaacggaacgaccccgtaagacccgtaccggttccgtttaataccgtggtacgtacgaggaagttcgttacggtaggttcgggtaccgggtaccttccgttcccgttggttcctacgttcgcgttcgttcggtccggggcgtccg

SEQ ID NO: 408914 - DNA, 588 bp, Homo sapiens
  misc_feature: GZ8MTXP01BEW0X.3.82.H05.1.454.CMB.2.raw
  modified_base (515)..(515): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtcctgagactctcctgtgcagcctctggcttcaccgtcagtagcagctacatgcacgtgggtcccgccgacggcgtccgaagggggaagggggcgtgggagtgggtctctagttatttacacttcgtggtaccactataacctacctcccgacccgtaggaacgggaccgtacttaaccactctaccagacgacgtacgttccgaagaacgacgggtatatactacaaatgaaaccaacgtgaacgcgaccgaacgacgacggtactttatactgtcgcgagntagttcggtgttcgggtccgggtacttccgccgttggtcctacgtgtacgtcgttcggtcggggttccgtcgg

SEQ ID NO: 408915 - DNA, 704 bp, Homo sapiens
  misc_feature: GZ8MTXP01BDRP5.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagactggaggaggcttgatccagccgtgggggtccctgagactctcctgtgcagcctctggcttcaccgtcagtagcagctacatgcacgtcgggtcccgccgaggcctaccggagggggaacgggggcgtgggaggtcggggtcttacgtagtttatttactaacgtttccgtaggtacccacaactaacctaccgtcccgaccccgtagggaacgggcccgtaacttaaccatcctaccgaagacgacgtaacgttacccggaagtaaccgtacgggttatacttacgttaacgaaaagttacgaaaccgtaaccggtaggaacggaccggacccgtaacgaacccgtaccgggttaccgtttaagttacgtggtcgaccgaggtaacgtacgttgggtacgggttcggggttaccgggggaaccccttccgttacccgttcgggtttaaccctaccgtttccggacgttccggttccgggttcgggggttcccggttccgg

SEQ ID NO: 408916 - DNA, 641 bp, Homo sapiens
  misc_feature: GZ8MTXP01A4NBU.3.82.H05.1.454.CMB.2.raw
  modified_base (284)..(284): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatcgtgtaggggacagagtcgctatgacttggtcgggcgtacgtcgtacggttttaacagtagtggttagtcgtggtatcagacaagaaaccgagggaaacnccccgtgacgttcctgtatgtctgctgacactcccacctagacaaaggtcgactcccatccagtattcgagtcgtacgaaaggtagaacgtcgtacggggaactaggtactttcaccttcctaccaacctactcgaagtccgaacgtccgcgacacgtaccgttagtaaacgttacttttacgaacgtttaaactttacgtagtttacgacaacgtacggaccttagaacccgtcttcccgtccccgtgttaacccgtcggtttaccggggacggaaacgggaaccgtaaggggttacggaacgttaacgtaaccgaaacggtaacgttggacggttcctaacggttaactaacccg

SEQ ID NO: 408917 - DNA, 807 bp, Homo sapiens
  misc_feature: GZ8MTXP01A0BF2.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgcgaggtggtggagacgtgggaggaggcttgactccgaggccggtgggggtccctgacgtactctccgtgtgcacgtcctcgtcggtcttccgaccgtcgagtacgcgacgtacctacagtcgcgtaccggtcgggcccgccgacggccgtaccgggaagggggacggggtcgtagggggtacggttcgggggttaccttagttaacggtttaactttaaccgtaacgtttccgtacggtaaccctaacgtaacttaaacccgttacccgtaaccccggtacccgggtaagggtaacccgggtaccgtaaacttaacccgacttaccgtaccgaaggtaaccggtaaccgtaacggttaccggaagaaacccgtagggtttaactacttaacgttaacgaaacgtacgtaaaacccgacggtacggaaacggaccgacccgtaaacgtacccggtaaccggtttaccgtttaacttccggtaggtacgacgtaaggtaacgttacggttcgggtacgggttcggggttaacccggtcccgttaacccgttcccgtttcggttaaccttaccgtcgttaacgtccggtttacgggtcccgggggttaaccgtcccggg

SEQ ID NO: 408918 - DNA, 695 bp, Homo sapiens
  misc_feature: GZ8MTXP01AQ6FQ.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccaggccgtgggggtccctgagactctcctgtgcacgcctcgtcggcttcaccgtcagtagcagctacagtcgcacgtcgggtcccgccgaggcctaccggaagggggagggggtcgtgggaggttgggtctacgtagtttatttaactaacttcgtaggtaaccactacttaacctacccgtcccggaaccccggtaggaaaccggggtccctaaattaaacccgattccctacccgaaggacgacgtacgttaccggaagtaaaccgtagggttactaactacttaacaaaacgttcgaaaaccgtaaccgtagggaacgaccggacccgaaacggtaaccctacggggttacccttttaagtcgtcggtaggaccgaaggtaacgtagttacgggtacgggttccggggttaccgggcccttaccgttcccgttggttcctacgttcgtctcgttccggtcgggggccctcggg

SEQ ID NO: 408919 - DNA, 798 bp, Homo sapiens
  misc_feature: GZ8MTXP01C9YAO.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccagccgtgggggtccctgagactctcctgtgcagcctcgtggcttcgaccgtcagtagcagctacatcgctacgtcgggtcccgccgaggccgtaccggagggggaacgggggcgtgggggtaggtgggggttccttacgttaaggttttactttaacgtaactttcgtacggtaacccactaacgttaaacccttaccgtccccggtaaccccggtagggaaaccggggtacccgtaaacttaaacccgactacccgtacccgtaaggaacgtaaccggtaacgtttaccccggaaaggtaaaaccgtaccgggtttagttaaaccttaccgtttaaacgaaaacgttacggaaaaacccctaaaccggggttacggaaacgggtaacccgaccccgggtaaaccgaacccggtaccgggtttaccgttttaactacgtggtacggacgagtaacggttacgttcgggtaacgggttccgggggtttacccgggaccctttccgttccccgtttcgggttttaaccttaccgttcgtaccgttccgttccggggtccgggggttcccgtaaccggg

SEQ ID NO: 408920 - DNA, 643 bp, Homo sapiens
  misc_feature: GZ8MTXP01DUPH6.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagacgtggaggaggcttgatccagccgtgggggtccctgagctctcctgtgcagcctcgtggcttcaccgtcagtagcagctacagtgcacgtcgggtcccgccgaggccgtaccggaagggggaaggggtcgtgggtaggtcgggttctcgtaagtttacttactaacttcgtacggtaccacgtactaaccgtacctcccggacccgtaggaaccgggtaccgtaacttaaccatcctaccgagacgacgacttaccgaagtaaaccgtcggttatactactaacaaatacgaaaccaacgtgaacgaccgaccgaacgaccgtacggttacctttaatacgtggtcgacgtagaagtgttcggaggtttcgggtaccgggtcccttcgttcccgttggttcctaacgttcgacgtccgttacgggtcggggttccgtccggg

SEQ ID NO: 408921 - DNA, 687 bp, Homo sapiens
  misc_feature: GZ8MTXP01D7YIU.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccagccgtgggggtccctgagactctcctgtgcagcctctggcttcaccgtcagtagcagctacatgcacgtggtccgccgaggcctccgagggggaacggggctgggagtcgggtctcgtagtttacttacaaatttcgtacggtacccaaacgtacttaaccgtaccgtaccccggaaccccggtaggaaaccggggtcccgtaacttaaacccacttaccttacccgaaggacgtaaccgtaacgtttaccccggaaagtaaaccggtacggggttattaacttacgtttaaccaaaagtttcggggaaaaccctaacccgttagaacggacgacccggaacgtacgtaaccgggttccgtttaataccgtggtgaacgtagagtattcggaagggttcgggttaccggggccttaccgcccgttgttccgttaactcgttacttccgttcggttccggggg

SEQ ID NO: 408922 - DNA, 670 bp, Homo sapiens
  misc_feature: GZ8MTXP01BYPLL.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccagccgtgggggtcctgagactctcctgtgcacgcctctggccttcgaccgtcagtagcagctacatgcacgtcgggtcccgccgaggcctaccggaagggggaagggggtctggggacggttgggggttcctacgtaagtttatttaactaacgtttcgtacggttaaccaacgtaacttaaaccctaacccgtcccggaaccccggtagggaaaccggggcccgtaaacgtttaacccatacctacccgagacgaacgtacttaccgaagaaaccgtacggtacttacgtacttacaaatacgaaactaaccggtgaacgacgaccgacgaacgtaccggtcgtttaagtacgtgtgcgagaagtagttcggaggttcggttacggggtccttccgttccgttcggttccttacgttcgtacgttcgttcggtcggggttccgtcgg

SEQ ID NO: 408923 - DNA, 660 bp, Homo sapiens
  misc_feature: GZ8MTXP01DWK3Y.3.82.H05.1.454.CMB.2.raw
  modified_base (547)..(547): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtgggaggaggcttgatccgaggccgtcgggggtccctgagactctcctgtgcacgtcctcgtcggtcttcgaccgtcagtagcagctacatcgctacgtcgggtcccgccgaggccgtaccggaagggggacggggcgtgggagtcgggtctacgtagttattactaacttcgtagtaccactactaaccctaccgtcccgacccgtaggaacgggccgtaactaaccatcctaccgagacgacgattaccgaaagaaccgtaggttatactacttaacaaagtacaaaccaaccggtgaacgtacgacccgtaacgaacccgtacggttaccttttaacncgtggtacggcgaaggtaagtacgttgggaaacgggtttcgggtacccggaccttacgttccgttggtttaacctacgtttcgacttccgacggttcgggggccctaaccggg

SEQ ID NO: 408924 - DNA, 606 bp, Homo sapiens
  misc_feature: GZ8MTXP01CCF6Q.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctattcaaaaggtgtccagtgtgaggtgcaggtggtggagacgtggaggaggcttgatccagccgtgggggtccctgagactctcctgtgcagcctctggcttcaccgtcagtagcagctacatgcacgtcgggtccgccaggctaccgagggggaaggggctgggaggtgggtctacgtagttatttacaacttcgtaggtaccacactaactacctcccggacccgtaggaacgggccgaattaaccatctaccagacgacgacttcccgaagaactacggtgtatcttacaaatgaaaccaacgtgagacgaccgacgaccacggtccgtttaatacctggtagcgagaagtacgttcggtagggttccgggttacgggtcccttccgttacccgttgggttaaccttacgttcgtactcgttccggtcgggggcccttcggg

SEQ ID NO: 408925 - DNA, 636 bp, Homo sapiens
  misc_feature: GZ8MTXP01AUTIY.3.82.H05.1.454.CMB.2.raw
  modified_base (259)..(259): a, c, t, g, unknown or other
  modified_base (284)..(284): a, c, t, g, unknown or other
  modified_base (299)..(299): a, c, t, g, unknown or other
  modified_base (343)..(343): a, c, t, g, unknown or other
  modified_base (350)..(350): a, c, t, g, unknown or other
  modified_base (365)..(365): a, c, t, g, unknown or other
  modified_base (391)..(391): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagactggaggaggcttgatccaggccgtggggggtcccgagactctcctgtgcagcctntggcttcaccgtcagtagcagctanatgcacgtgggcccncaggcctcgaggggaacgggctgggagtgggtctgagttattanatttccnggtacacatactacncccgcccgtgaaacgggccataaccntctccagagacgacttaccgagaacgacggtagtactactacaaactacgaaacaccgtagggacgacggaccgaacgaccgtaccggtaccgtttacgttacgtcggttcgacgtacgtaggtaacgttccggttaagggttccgggttaccggggggtaaccctccgttaccccgttcgggtttacccttaacgttaccggttaactccggttccggttcggggggtcccgttcggggtcccg

SEQ ID NO: 408926 - DNA, 653 bp, Homo sapiens
  misc_feature: GZ8MTXP01B5OK7.3.82.H05.1.454.CMB.2.raw
  modified_base (464)..(464): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctcgtggcttcaccgtcagtagcagctacatgcacgtcgggtcccgccgaggcctaccggagggggaggggcgtgggaggtgggtctcgtagtttatttactaacttccgtagtaccactactaaccctaccgtcccggacccgtaggaacgggaccgtaacttaaccactcctaccagaacgacgtacttaccgaagaacgtacggtntaactcttaacaaagtcgaaaccaaccggtagacgacgacccgtaaacgaccgtaccggtacttttaagttaccgtggtacgcggaagtaagtacgtttacgggacgggtttcgggtacccggggtaaccttccgttacccgttggtttcctacggttcgtacgttcggttcggtcgggggcccgtcgg

SEQ ID NO: 408927 - DNA, 603 bp, Homo sapiens
  misc_feature: GZ8MTXP01DYSXS.3.82.H05.1.454.CMB.2.raw
  modified_base (498)..(498): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgagatgcaggtggtggagactggaggaggcttgatccagccgtgggggtccctgagactctcctgtgcagcctctcggactcacctcacgctcaagtcggccacgtacgtggacgtggggtcccgccgacggcgtccggagggggacgggggcgtgggtaggtggggttcggtccggttcgtaggacgaccaacaaacgtaaacagtaacgaaccaacccgacaaaccgaaactaccgcccgcgtcgtagtaggaaagcagtacttccaacctatctacaagagatgaattcaaggtaacgtaactctactttanctagacaaatgaactagcctggaaacgaaccgacgaacgaccgtacgtcttagtttcttgtcgttaactaagtacgaccgttaagtaacgttaacgtaaaccggg

SEQ ID NO: 408928 - DNA, 895 bp, Homo sapiens
  misc_feature: GZ8MTXP01C4QF5.3.82.H05.1.454.CMB.2.raw
  modified_base (256)..(256): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtgggaggaggtcttgatccgagccgtggggggtccctgagctctcctgtgcncgcctctcggtcttccgaccgtcagtagcagctacatcgctacgtcgggtcccgccgacggcctaccggaagggggaagggggtcgtggggacggttcggggttcttacgttaaggtttactttaacgtaactttaccgttacggtaaccctaactaacttaaaccccgtacccgttccccgggtaaccccgtacgggaaacccggggtaccccgttaaacttaaccccgtaacgttcccttaacccgaaaggtaacggtaaccggtaacgtttaccccggaaaaggttaaaacccggtacggggtttatttaaacgttacccgttaaactaaaaacgttaaacgggtaaaaccccttaaacccggggttaagggaaacggggaaaccccggtaaccccgggaaaccggtaaacccggttaacccggggtttaccccgttttttaaaagttaccggttgggtacggttaccgggaaaggtaaaggttacggtttacggggtaaacggggttttcccgggggttaacccgggggtaacccctttaccggttccccggttttacggggttttccccttaacgttttccgggtaaccttccggtttcccgggggtccgggggttccccggtttaacccgggg

SEQ ID NO: 408929 - DNA, 630 bp, Homo sapiens
  misc_feature: GZ8MTXP01BVCA1.3.82.H05.1.454.CMB.2.raw
  modified_base (316)..(316): a, c, t, g, unknown or other
  modified_base (427)..(427): a, c, t, g, unknown or other
  modified_base (465)..(465): a, c, t, g, unknown or other
  modified_base (540)..(540): a, c, t, g, unknown or other
  modified_base (617)..(617): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcagggtggtggagacgtgggaggaggcttgactcccgaggtccggtcggggggtccctgacgtacctctcctgtgcagcctcgtggcttcaccgtcagtagcagctacatgcacgtcgggtccncgaggctccggagggggagggctagggacggttgggtctacgtagtttaacttactaattcgtacgtacccaactactctacctcccgacccgtagacgggcctataaccntcctaccagacgacgtattacccgagaactacgggttnacttctaacaaacgttcggaaactaaccgtgaacgaccgaccggacgaacgtaccggttctttaatacgtggtcncggtaagacgtgttccgggagggttcgggttacccgggccttaccggtccgttggttccttacgttcgattcccggngggttcccggggg

SEQ ID NO: 408930 - DNA, 698 bp, Homo sapiens
  misc_feature: GZ8MTXP01AJLHM.3.82.H05.1.454.CMB.2.raw
  modified_base (306)..(306): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtggaggaggcttgatccgagccgtgggggtcctgagactctccgtgtgcacgcctcgtggcttcgaccgtcagtagcagctacatgcacgtcgggtcccnccgacggctaccggagggggacgggggcgtgggagtgggtctcgtagtttattactacttcgtaggtaaccactataaccctaccgtcccggacccgtagggaaacggccgtaattaaccatccacgagaacgacgtacttaccgaagaaaccgtcgggttatactacctacaaatcgaaaccaaccgtggaacgtacgaccgaacgtaaccgtacggtaccgttttaataccgtggtacgaccggtaaggtaacgttacgtttcggggtaaggtttccgggggttacccggggaaccccttacccgttaaccccggttgggttttaacccgtaaaccgttttcggaaccgttcccgttccgggggttaaccggggcccggtttaacccggg

SEQ ID NO: 408931 - DNA, 733 bp, Homo sapiens
  misc_feature: GZ8MTXP01CBM7M.3.82.H05.1.454.CMB.2.raw
  modified_base (273)..(273): a, c, t, g, unknown or other
tcagagacgcactccacgaccggtgctcgatttagtcgagctctctcgcgggggggagaggagcccagcactggtattccgaggtgtttccattcggtgatcagcactgaacacagaggactcaccatggagttttggctgagctgggttttccttgttgctattcaaaaggtgtccagtgtgaggtgcgaggtggtggagacgtggaggaggcttgatccagccgtgggggtcctgagactctcctgtgcacgcctcgtcggcttcaccgtnagtagcagctacatcgacgtacgtcgggtcccgccgacgggtccgtccggaaggggggaacgggggcgtaggggtacggttcgggggtcttacgtaaggttttactttaacgtaacgtttcgtacggtaaccctaaccgtaacttaacccttaacccgtccccggtaccccgggtagggaaacccggggtaccgtaacttaacccgactcccgtaacccgaggaacgtacgtaacttacccggaagtaaacggtaccggtagttactacttaacaaaatcgaaaaccaaccggtgaacggaccgtacccgaacggtaccgacggggttaccctttaagtaccgtggtcggacggagtaacggtgttccgggagggttcgggttaccgggacccttccggttcctttcgggttcttaccgttggtaccgttcgttccggggtcggggttccccgtaacggg

SEQ ID NO: 408932 - DNA, 639 bp, Homo sapiens
  misc_feature: GZ8MTXP01C7Y2M.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcacgcctcgtggcttcaccgtcagtagcagctacatgcacgtgggtccgccgaggcctaccgagggggaaggggctgggagtgggtctactagtttatttacaacttctacggtaccacactaacctactcccggacccgtaggaacggggccaacttaaccgatctaccagaacgacgtacttaccgaagaacgtacggttagttactacttacaaacttacgaaacctaaccgtaggaacgacgacccggaaccgaaccgtaccggtaccgttttaataccgtggtacgacgtaagaacgtagttcggtacggttcgggttaccggggtcccttcgttacccgttggttaaccttacgttcgactccgttcgtcggggccgtccgg

SEQ ID NO: 408933 - DNA, 714 bp, Homo sapiens
  misc_feature: GZ8MTXP01ERLCO.3.82.H05.1.454.CMB.2.raw
  modified_base (690)..(690): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctggggttttccttgttgctatttcaaaaggtgtccagtgtgaggtgcaggtggtggagacgtggaggaggcttgatccagccgtgggggtccctgagactctcctgtgcagcctcgtggctcaccgtcagtagcagctacatcgcacgtcgggtcccgccgaggccgtaccggaagggggaacgggggtccgtagggggtaaggttcgggggtacttaccgttaaggtttaactttaacctaaacgtttcgtacggtaccctaactaacttaaaccctaccgtcccgaccccggtaggaacggggtaccctaattaacccaattcccgtaccgagtaacgtaacgtacgttacccgaagtaaaccgacgggttagtaacttaccgttaacaaaattacggaaaccctaacccggtaaggaaacggaaccgaccggaaaccgtaccgaaccggttccggtttaaataccgtggtataccggaagaacgtaagttcggtagggttacggtcggggtacccttccgttccgttacggttctacttcggntcgttcgggtcgggttcccgtcgg

SEQ ID NO: 408934 - DNA, 611 bp, Homo sapiens
  misc_feature: GZ8MTXP01BZ09D.3.82.H05.1.454.CMB.2.raw
  modified_base (446)..(446): a, c, t, g, unknown or other
  modified_base (455)..(455): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggtaggtttgatccgagccgtgggggtccctgagactctcctgtgcagcctctggcttcaccgtcagtagcagctacatgcacgtggtccgcgaggctccgagggggaagggcgtggagtgggtctcgtagttattacattcctcggtacactactacctaaccacccgaacccgtagaaccggggacctaacgttaaccatcctaccagacacgtacttccggaagaacgtacggtntactctaanaaaatcgaaacaccgtgggaacgagacccgacgaccgtacggtcctttataccgtgtacgactaggagtgttcggagggttcgggttccgggaaccctcgaccgtttggttaccttaagttcgaacttcgtcggttacgggggccttcgggaaccc

SEQ ID NO: 408935 - DNA, 589 bp, Homo sapiens
  misc_feature: GZ8MTXP01CXV0F.3.82.H05.1.454.CMB.2.raw
  modified_base (409)..(409): a, c, t, g, unknown or other
  modified_base (441)..(441): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggtagtttggctgagctgggttttccttgttgctatttcaaaaggtgtccagtgtgaggtgcaggtggtggagactggaggaggcttgatccagccgtgggggtccctgagactctctgtgcagcctctggcttcaccgtcagtagcagctacatgcacgtggtccgccgaggcctccgagggggaggggctgggagtcgggtctcgagtttacttacaatttcgtaggtacccaactataacctactcccgaccccgtgaacgggccgtaattaaccnctctccagagacgtattaccgagacacgggtntacttcttaacaattacggaacacgtagagacgccgacgacgaccggtccgtttagttactgtgcgagagtacgttcgaggttcgggttccggggttccttccgtaacccgttggttccttacgtcgttacgtcgttcgggtccgggg

SEQ ID NO: 408936 - DNA, 714 bp, Homo sapiens
  misc_feature: GZ8MTXP01A3171.3.82.H05.1.454.CMB.2.raw
  modified_base (548)..(548): a, c, t, g, unknown or other
  modified_base (612)..(612): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagtcttgggttttccttgttgctatttcaaaaggtgtccagtgtgaggtgcgaggtggtggagacgtgggaggaggcttgatccaggccgtgggggtccctgacgactctcctgtcgcacgcctcgtcggtcttccaccgtcagtacgcagctacatcgctacgtcgggtcccgaccgaggtccgtaccggaagggggaacgggggtcgtaggggtaggttcggggttacttacgttaaggtttaactttaaccgtaactttcggtacgtaacccgaactaacttaaacccgtacccgtaaccccggaacccggtagggaaacccgggtaccctaaactaacccgtaacttacccgacgaaacggtacggaacttaacgttacccgaaaggtaaaccgtacgggttnttaacttacttaacaaattcgaaaccacggtagacggacgccgaacgactccggttacctttancgtgcggtcgaagtaacgtagttcgggacgttcgggggtacccggtacccttacgttcccgttggttaaccctagtcgacgtcgacgggtccggggctccgg

SEQ ID NO: 408937 - DNA, 691 bp, Homo sapiens
  misc_feature: GZ8MTXP01EYCU5.3.82.H05.1.454.CMB.2.raw
  modified_base (458)..(458): a, c, t, g, unknown or other
  modified_base (492)..(492): a, c, t, g, unknown or other
tcagagacgcactccacgaccggtgctcgatttagtcgagctctctcgcggggggggagaggagcccagcactgggattccgaggtgtttccattcggtgatcagcactgaacacagaggactcaccatggagttttggctgagtcttgggttttccttgttgcttatttacaaaaggtgtccagtgtgaggtgcgaggtggtggagacgtgggaggaggcttgactccgacggccggtcggggggtccctgacgtactctcctgtgcacgcctcgtcggcttcaccgtcagtagcagctacatcgccacgtcgggcccgccgacgggcctaccgggaagggggacgggggtcgtaggggtaggttcgggtcttacgtaagtttactttaactacgtttcgtacggtaaccactactaaccctacctcccggacccgtaggaacggcctaattaaccntcctacagacgacgtatccgaagtaacacggttntactctacaaatacgaaacctacggtagaacggaccgtaccggaacgtaccgtaccggttacgttttaacgtacggtgtacggacgtaacggaaggttacttacgggggtagggttccggggttaccgggtaccccttacgttcccgttgggttaacctacgttcgagttccgttcgggtcccggggttcgtaacccgg

SEQ ID NO: 408938 - DNA, 660 bp, Homo sapiens
  misc_feature: GZ8MTXP01AJT0S.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgccacgtcgggtcccgccgaggcctccggaagggggaacgggggcgtgggaggtggggtctcgtagtttatttacaacttcgtaggtacccacacttaaacctacccgtcccgaccccgtaggaacggggcctaattaacccatccctaccgagacgacgtacttcccgaagaaccagggttataactcttaacgaaatacgaaaccaaccggtgaacggacgaccccgaacgaccgtacggtacccgttttaattaccgtggtacgacgaggaacgtagttcgggaaggttcggggttccggggtaacccttccgttaccccgttgggtttcccttacggttcgtaacgtccgttcgggtcggggccgttccgg

SEQ ID NO: 408939 - DNA, 868 bp, Homo sapiens
  misc_feature: GZ8MTXP01ACX12.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtggaggaggcttgatcagccgtgggggtcctgagactctcctgtcgcagtcctcgtggtcttcgaccgtcagtacgcagctacatgcacgtcgggtccgccgaggcctccggaagggggaacgggggtcgtgggtaacggtcgggggtaccttacgtaaggtttaacttttaaccgtaactttaccgtacgggtaacccaacgtaacttaaacccgttaacccgttccccgggaaacccccgggtagggtaaaccggggtaccccgtaaacgtttaaaccccgactttaccccgttaacccgaaagggtaacggtaaaccggtacgtttaccccgggaaaggtaaacccggtaaccggggtttattaaacgtttacctttaaacgaaaaaacgttacggtaaaaaccccgtaaacccggggttaggaaaaccgggaccggtaacccccggaaacggtaaaccccgtaacccggggtttaacccgtttttaaacgttacccgttgggtacggtacccggtaagggtaagttaacggtttcgggggtaaacggtttcgggggtttaaccccggggtacccttacccgttaccccggtttacgggtttcccttaaccgttccggtaactccggtttccgggtccgggggttcccgttaacccggg

SEQ ID NO: 408940 - DNA, 644 bp, Homo sapiens
  misc_feature: GZ8MTXP01AR702.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtggggggtccctgagactctcctgtgcagcctcgtggccttcaccgtcagtagcagctacatgcacgtcgggtccgccgacggctccggagggggaacgggggcgtgggaggtcgggtcttacgtagtttacttaactaacgttcgtacggtaaccctactacttaaacctacccgtcccgaccccggtaggaaccgggaccgtaactaaccactacctaccgaaggacgtacgtacttaccggaagtaaacgacgggttatactacttaacgaaatcgaaaccacggtagagacgacccgaacgacgtcggtactttaatcgtgtcgagaggaatacggttgggacggttcggggtaccggtaccttccgaccgtttggttccctaggttcagttcgttcgggttcgggccgtccgg

SEQ ID NO: 408941 - DNA, 672 bp, Homo sapiens
  misc_feature: GZ8MTXP01DGYRQ.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggtttttccttgttgctatttacaaaaggtgtccagtgtgaggtgcaggtggtggagacgtggaggaggcttgatccagccgtgggggtccctgagtactctcctgtgcacgcctctggcttcaccgtcagtagcagctacatcgctacgtcgggtcccgccgagggcctccggaaggggacgggggcgtagggaggtgggtctacgtagtttacttaactaacttcgtagtacccatactaacctaccgtcccgaccgtaggaacggcctaattaaccatccctaccaagacgtacgtacttaccggaagaaacgtacgtagttaactcttaacaaacgttacgaaacctaacggtaggaacgaacgacccgaaaccgtaaccgtaccggttaccgtttaacttacgtgtacggacgtaagtaacgtacgttcgggtacgggttcgggttccggggaccccttacggttacccgtttcggttaactaccgttcgacgtcgttccgggtcggggttccgtccggg

SEQ ID NO: 408942 - DNA, 586 bp, Homo sapiens
  misc_feature: GZ8MTXP01E1JPK.3.82.H05.1.454.CMB.2.raw
  modified_base (190)..(190): a, c, t, g, unknown or other
  modified_base (491)..(491): a, c, t, g, unknown or other
  modified_base (496)..(496): a, c, t, g, unknown or other
tcagagacgcactccacgaccggtgctcgatttagtcgagctctctcgcggggggggagaggagcccagcactgggattccgaggtgtttccattcggtgatcagcactgaacacagaggactcaccatggagttttggctgagctgggttttccttgttgctatttcaaaaggtgtccagtgtgaggtncaggtggtggagactggaggaggcttgatccagccgtggggggtccctgagactctcctgtgcagcctctggcttcaccgtcagtagcagctacatgcacgtgggtccgccaggctccgagggggaagggggctggagtgggtctcagttatttacaacttctggtaccacataactacctccgaccccgtgaacgggcgattaaccatctccagagacgattccgagaacacggtgtactctacaaatgaaacaaccgtgagacgacccgacgaccgacggtccgtttaatactgtgcgngaagngttcggagttgggttccgggggtaacccttccgttaccccgttcgggtttaacctacgttccgactccgttcgtcgggggcccgtccggg

SEQ ID NO: 408943 - DNA, 616 bp, Homo sapiens
  misc_feature: GZ8MTXP01EAFBB.3.82.H05.1.454.CMB.2.raw
  modified_base (309)..(309): a, c, t, g, unknown or other
  modified_base (315)..(315): a, c, t, g, unknown or other
  modified_base (577)..(577): a, c, t, g, unknown or other
tcagagacgcactccacgaccggtgctcgatttagtcgagctctctcgcgggggcaggagtcagacccagtcaggacacagcatggacatgacgggtccccgctcagctcctggggctcctgctgctctggttcccaggttccagatgcgacatccagatcgacccagtcctccactccctccgtgtctgcatcgtggtaggggacagagtcgctatgtacttggtcgggctacgtcgtacggttttaacagtattggttagtcgtggtatcgagacaagaaaccgaagggaacgcccctgacgttccngatgtntgctgccactcccacctgactaaacggtgactcccgactcccgaagtacttcgacgtaccgtataaggtgaaacgtcggtagggaactagggtacttacacctactaccaccactcgagtaccacgcccgtagccacgtcctaagtaacgttagttttacgaactttaaacttacgttaagtttactacgtaaacgaacggtctacgaacgtcctcccgtaacccgtcttaccgtacggtttacggacgggtaacggaccgngggttacgaagaactaacgaaacgacgttgttcgcgtcg

SEQ ID NO: 408944 - DNA, 596 bp, Homo sapiens
  misc_feature: GZ8MTXP01BM1J7.3.82.H05.1.454.CMB.2.raw
  modified_base (298)..(298): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtcgggtccnccaggctccggaagggggaggggcgtgggagtgggtctcgtagtttatttaacaacttctggtaaccacataacctactcccgaccccgtggaaacgggcccgtaattaaccatcctaccaagtacgacgattacccggaagtaaaccgacggttagtactactacaaatacgaaacaaccggtgaagacgaccgaacgaccgtacggtaccgtttactacgtcgacgcgagaagtattcggagttgggtcgggaccttcgccttggtctacgtcgactcgttcggtcgggccgtcgg

SEQ ID NO: 408945 - DNA, 718 bp, Homo sapiens
  misc_feature: GZ8MTXP01ECLO0.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtggaggaggcttgatccagccgtgggggtcctgagactctcctgtgcacgcctcgtggcttcaccgtcagtagcagctacatcgcacgtcgggtccgccgacggccgtaccggaagggggaacgggggcgtaggggtaggttcgggggttacttacgtaaggtttactttaactaaacgtttcgtacggtaaccctaactacttaaacccgttaaccctcccgggtaaaccccgttagggaaaccggggtacccgtaaacgttaaacccacttacccgtacccgaaggtaaacggaaccgtaacgttacccggaaagtaaaccgtacgggttataacttacttaacgaaaatcgaaaaccaaccggtaggaacgacgacccgaacgaaccgtacggttaccgtttaaatccgtgtcgacgagtaacgtgttcggtagggttcgggtccgggtaaccttccgttaccgttggttaacctacgtcgtactcgttacggtcggggttccgttccgg

SEQ ID NO: 408946 - DNA, 669 bp, Homo sapiens
  misc_feature: GZ8MTXP01EVBCP.3.82.H05.1.454.CMB.2.raw
tcagagacgcactccacgaccggtgctcgatttagtcgagctctctcgcgggggggagaggagcccagcactaggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctcgtggcttcaccgtcagtagcagctacatgcacgtcgggtccgccgaggctccgaggggagggctgggagtggtctctagttatttacaacttcgtaggtaccactactaacctaccgtcccgaccccgtaggaaccgggccgtaacttaaaccgacttcctaccaaggacgaaccgtacttacccggaagtaaaccgtacgggttagttaactacttaacaaaattacgaaaccaaccggtggaaacgacgacccggaacgtaccgtaaccgggttacccgtttaagttaccgtggtacgacggaaggtaacgtacgttacggtacgggtttcggggttaccggggtaacccttccgttaccccgttgggttaaccttacgttcgtacgtccgttcggtcgggcccgtcgg

SEQ ID NO: 408947 - DNA, 633 bp, Homo sapiens
  misc_feature: GZ8MTXP01CB0T7.3.82.H05.1.454.CMB.2.raw
  modified_base (462)..(462): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccgagccgtgggggtccctgagactctcctgtgcagcctctggcttcaccgtcagtagcagctacatgcacgtcgggtcccgccgaggccgtccggagggggaagggggctgggagtggggtctcgtagtttatttactaacttctaggtaccacactaacctaccgtcccgacccgtggaacgggccgacttaaccatcctaccgaagacgacgtacttaccggaagaaaccgtacgggttntactcttacgaaaattacgaaaccaaccggtaggacgacgaccgaaccgacgtacggtctttaatcgtgtgcgaggtaagtcgttcggacggttcgggtaccggggtacccttcgttaccccgttggtttccttcgttaacgtcttccggcggttccggggcccgttccgg

SEQ ID NO: 408948 - DNA, 758 bp, Homo sapiens
  misc_feature: GZ8MTXP01BVNSE.3.82.H05.1.454.CMB.2.raw
  modified_base (290)..(290): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgcttatttcaaaaggtgtccagtgtgaggtgcaggtggtggagacgtggaggaggcttgatccgagccgtgggggtccctgagactctcctgtgcacgcctcgtggcttcgaccgtgagtagcagctacntcgcacgtcgggtcccgccgaggccgtaccggaagggggaacgggggtcgtagggggtaggttcgggggttaccttacgttaaggttttaactttaacgtaaacgtttccgttaggtaaccctaactacttaaaccctacccgttcccggaaccccgggtaggaaaccggggtacccgtaacttaacccatacccgtacccgaagtacggaccgtacttaccggaaagtaaccgtcgggttatacttacgttaacaaaacttcggaaaccctaaaccggggttggaaacgggtaacccgacccggtaaaccgggtaacccctaccgggggtttacccttttaagttaccgtggtacggaccggtaaggaacggttacggtttcgggacggtttcggggttacccggggaacctttcccgttaccgttggttcccttacgtcgtactcggttccggtcgggcccgtcgg

SEQ ID NO: 408949 - DNA, 702 bp, Homo sapiens
  misc_feature: GZ8MTXP01ETZCX.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtggaggaggcttgatccgagccgtgggggtccctgagactctcctgtgcagcctcgtggcttcaccgtcagtagcagctacatgcacgtcgggtcccgccgagggccgtaccggaagggggaacgggggtcgtggggaggttcggggtcttacgtaagtttaactttacgtaaactttccgtaggtaacccactactaaacctaccgtcccgaccccggtagaacgggcccgtaattaaccacttactccaagacgaacgtacttacccggaagtaaaccgtacgggttataacgttacttaacaaatacggaaacctaaccgggtggaacggaacgcccggaaacgaccgtaaccggttccgttttaatacgtggtacgacggtaaggtaacgtacgtttacggagggtttccggggttaccgggtacccttcccgttacccgttcgggtttaacctacgttcgtagtccgttcggtcgggggttcccgtaacggg

SEQ ID NO: 408950 - DNA, 666 bp, Homo sapiens
  misc_feature: GZ8MTXP01BG563.3.82.H05.1.454.CMB.2.raw
  modified_base (276)..(276): a, c, t, g, unknown or other
  modified_base (588)..(588): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgcttatttcaaaaggtgtccagtgtgaggtgcgaggtggtggagacgtggaggaggcttgatccgagccgtgggggtccctgagactctctgtgcagcctctggcttcaccgtnagtagcagctacatgccacgtcgggtcccgccgacggccgtaccggagggggaacgggggcgtgggtaggtgggtctacgtagtttacttactaattcgtaggtacccaaactacttaacctaccgtccccggaaccccggttaggaaaccggggtaccctaaacgtttaaacccacttacccgttaccgaagggaacgtaccggtaacgtttacccggaaacgaaaccgtaccggggttattaacttacttaacgaaattacggggaaacaacgtaggacgacgaccgacgacgacggttcttatacgtgngaacggagttagtcgttcggtaggtcgggttaccgggccttcgaaccgttggtcttacgtgttactcgttcggtcggg

SEQ ID NO: 408951 - DNA, 673 bp, Homo sapiens
  misc_feature: GZ8MTXP01C5UN6.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggagggaggcttgatccagccgtgggggtccctgagactctcctgtgcacgctctggcttcaccgtcagtagcagctacatgcacgtcggtccgccgaggtcgtaccggaagggggaacgggggtcgtcgggtaggttggggtctacgtaacggttttaactttaacctaaagtttcgtacggtaacccctaaactaataacccgttaacctccccgggaaccccggttaggaacggggcctaaacttaaacccattccctaccaagacgtaccgtaactacgaacgaactacgggtatactcttaaacaaattcgggaaaactaacgtagaaggacgacccgtaacgacgtaacggtcctttaataccgtgtcgtaacgaggttagtagttcggtaggttcgggttccggggacccttcgtaaccccgtggtttcctacgttcgttacgttcgttccggtcggggg

SEQ ID NO: 408952 - DNA, 702 bp, Homo sapiens
  misc_feature: GZ8MTXP01AR8LT.3.82.H05.1.454.CMB.2.raw
  modified_base (179)..(179): a, c, t, g, unknown or other
  modified_base (257)..(257): a, c, t, g, unknown or other
  modified_base (260)..(260): a, c, t, g, unknown or other
  modified_base (283)..(283): a, c, t, g, unknown or other
  modified_base (532)..(532): a, c, t, g, unknown or other
  modified_base (610)..(610): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagtcttgggttttccttgttgcttatttacaaaaggtntccagtgtgaggtgcgaggtggtggagacgtggaggagcttgatccgagccgtcgggggtccctgacgctctcctgtncancctctggtcttcaccgtcagtancagctacagtcgcgtaccggtcgggtccccgaccgacggtcccgtaccggaagggggaagggggtcgtaggggtacggttcggggttcttacgttaagtttaactttaaccgtaacctttcgtacggttaaccaacctaacttaaacccttacccgtccccggaacccggtacggaaacggggtaccctaacttaacccacgttacccacgaagacgtaacgtacttaccggaaagtaccgtacggttntaactaccttaacaaatacgaaaccaacgggtgaacgcgaccgaacgaccgtacgttcgtttaatcgtgtgacgtagngtacgttcggacggttcgggttacccggcttccgttccgttggtttaaccctaggttaacgtctccgttacggggttccgggaaccgttcgg

SEQ ID NO: 408953 - DNA, 710 bp, Homo sapiens
  misc_feature: GZ8MTXP01EKFRK.3.82.H05.1.454.CMB.2.raw
  modified_base (262)..(262): a, c, t, g, unknown or other
  modified_base (502)..(502): a, c, t, g, unknown or other
  modified_base (594)..(594): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgcttatttcaaaaggtgtccagtgtgaggtgcgaggtggtggagacgtgggaggaggcttgactccgagccgtggggggtccctgagactctcctgtgcncgcctcgtggccttcaccgtcagtagcagctacatgcacgtcggtcccgcgaggcctaccggagggggacgggctggggagttgggtctacgtagtttaactttactaagtttcgtaggtacccaactactaacctaccgtacccggaccccgggtaggaaaccggggtacctaaacttaacccacttccgtaccgaaggaacgtaacgtacgttacccggaaggtaaacctacgggttnttaactactttaacgaaactacgggaaaccctaaccgttggaaacggaccgccccggaaacgtaaccggtaaccggttcttttaagtaccgngttacggaagtagttaggtacgtttacggacgggtttcggggttacccggggttaccttccggttaaccccgttggtttaaccttacggtcgcgtttccggttcgggtcccggggg

SEQ ID NO: 408954 - DNA, 613 bp, Homo sapiens
  misc_feature: GZ8MTXP01AIXR8.3.82.H05.1.454.CMB.2.raw
  modified_base (527)..(527): a, c, t, g, unknown or other
  modified_base (555)..(555): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgcttatttcaaaaggtgtccagtgtgaggtgcaggtggtggagacgtggaggaggcttgatccagccgtgggggtccctgacgactctcctgtgcacgcctcgtcggcttcacccgtcagtagcagctacatcgcacgtcgggtcccgccgaggcctaccggagggggaggggcgtgggaggttgggtctcgtagtttattactacttcgtagtaccatactaacctacctcccgaccccgtaggaacgggccctaacttaaccatccaccagacgacgtatccgaagaaacgtcggtatacttactacaaatcgaaaccacggtaggaacgtacgacccgaacgaccgtaccgggttacttttaanacgtggtaccgagagtaagtgttacggngttcggggtccggaccttcgccgttggtcttacgttcgctcgttcgtcgggttcgtcg

SEQ ID NO: 408955 - DNA, 790 bp, Homo sapiens
  misc_feature: GZ8MTXP01CKY78.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggtagttttggctgagtcgttgggttttccttgttgtcttatttacaaaggtgtccagtgtgaggtgcgaggtggtggagacgtggaggaggtcttgactccgaggccggtcgggggtccctggacgtaccttctccgtgtcgcgtacgtcccttcgtcggtccttccgaccgtcagtacgcacgtctacagtcgccgtacggtcgggtccccgaccggacggtcccgtaccgggaagggggtacgggtccggtagggggtacggttcgggttaccttacgttaagttttaacgtttaaccgtaaccgtttaccgtacggtaaccctaactaaccgttaaaccccgttaaccccgtaaccccgggtaccccgggtaaacgggaaccgggtacccgtaaacttaacccgtacgtacctaccgtaagaccgtaacgtacgtaaccgaacgtaacgtacggttactaacgttacctaaactaaacgtacaaaccgtacggaggaacggaccgaaccgaaccgtaccggtaccggttacgtttaacgtacgtgtaggtaccgtaggtaagttacgttgggtacgggttccgggtaccgggtccttaccggttccgttaggttcctacgttcgacgttcggttaccgggtcgggttcccgtaaccgg

SEQ ID NO: 408956 - DNA, 693 bp, Homo sapiens
  misc_feature: GZ8MTXP01CHGYW.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtggaggaggcttgatccgagccgtcggggggtccctgacgactctccgtgtgcacgcctcgtcggtcttccgaccgtcagtagcacgctacatcgctacgtcgggtcccgccgaggcctaccggaggggacggggcgtgggtaggtcgggtcttcgttagtttactttacgtaacgtttccgtacggtacccacgtactaaacccttacccgtcccggaccccggtagggaaccgggtccgtaacttaaccgactcccgtaccgaggacgtacgtaacgttacccggaagtaaaccggtcgggttattacgttaccttaacaaagttcgaaacctaacggtgaacggaccgacccggtacgaccgtaccggtccttttaagtacgtggtacgacgtagtaacgtcgttcggacggttcggggttcccggcttccgttacccgttgttcctacgttcgcgttcgttccgggtaacggggcccgtaacgg

SEQ ID NO: 408957 - DNA, 909 bp, Homo sapiens
  misc_feature: GZ8MTXP01D0M0Q.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccgagccgtgggggtcctgagactctctgtgcagcctctcggcttcaccgtcagtagcagctacatcgccacgtcgggtccccgccgagggcctaccggagggggtaacgggggtcgtggggaaggttcggggtacttaccgttaaggttttacttttaaccgtaaacgtttccgtacgggtaaccctaaccgtacttaaaaccccgttacccgttaaccccgggacccccggttaaaggggtaaacccggggtaccccgtaaacgtttaaaccccgtactttaccccgtaacccggtaaaggtaaccggaaaccggttaaccgtttaaccccgggaaaacggtaaaaccccgggttaaaccgggggtttactttaaaccggttaccctttaaacccgtaaaaacggtttaaccggaaaaaccccgtaaaccccggggtttaggggaaaaccggttaaacccgggtaacccccgggaaaccggtaacccgtaacccgggggtttacccgtttttaaacgtttacccgtaggggttaccgaaccggaaagggttaacggtacgtttccggggtaaggtttacccggggggttacccggggtaacccttcccggttaaccccggtttcggtttaaccctttccgttaacggtacttcccggttacggtccggggggttcccgttaaccgggg

SEQ ID NO: 408958 - DNA, 913 bp, Homo sapiens
  misc_feature: GZ8MTXP01B9ZEE.3.82.H05.1.454.CMB.2.raw
  modified_base (254)..(254): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagtttggctgagctgggttttccttgttgctattcaaaggtgtccagtgtgaggtgcgagggtggtggagacgtggaggaggcttgatccgacgcggtcgggggtcctgagctctcctgtcgcncgtcctcgtcggcttccgaccgtcaggtacgcagtctacagtcgcgtacgtcggggtccccgaccgtacgggcccgtaccgggaaggggggacgggggtcgtcgggggtaaggttcgggggttaccttacgttaagttttaacgtttaacgttaacccgtttccgtacggtaaccctaacgtaaccttaaacccttaaccccgttaacccgggtaaccccgggttaaacggggtaaacccggggtacccttaaacgtttaaaccccgtacgttaccccgtaaaccgaaacggtaaccggtaaaccggttaccgttaacccgggaaaacggtaaaacccggttacggggtttacttaaccttaacccggttaaataaaacggttaaccgaaaccccgttaaaccgggttcggggaaaacggtaacccgggaaccccggtaaaaccggtaccggttacccggggtttaaccttttttaaacgcggttaccggggtaggtacccgggtaaaggtaacgggttaacgtttaccgggggtaacggggtttaccggggttccggggtaaacccctttccggggttaacccgtttcgggttttaacccgtcgtttaacggtccgttcccggggttggggtcccgggggttcccgttaaccccgggg

SEQ ID NO: 408959 - DNA, 725 bp, Homo sapiens
  misc_feature: GZ8MTXP01AS1HZ.3.82.H05.1.454.CMB.2.raw
  modified_base (265)..(265): a, c, t, g, unknown or other
  modified_base (278)..(278): a, c, t, g, unknown or other
  modified_base (283)..(283): a, c, t, g, unknown or other
tcagagacgcactccacgaccggtgctcgatttagtcgagctctctcgcggggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtgggaggaggcttgatccgagccgtggggggtccctgacgtactctcctgtgcagcctntggtctcaccgtnagtancagctacatgcacgtgggtcccgccagggtctaccggagggggaacgggggtctgggagtgggtctcgtagtttattactaactttctagtacctactactaaacctaccgtcccgaccccgtaggaaacggggccctaattaacccatacctacccgaagaacggaacgtacgttacccggaaagaaaccgtacgggttattaactacttaaacgaaaacttacggaaaaccctaaccggtagaaacgggtaaccgaacccggaaccggaaacccgtaccgggttaacccgttttaaagttacccgtggtacggaccgaagggtaagttacgttccggggaaacggtttccggggtaccgggggtaccccttacgttaccccgtttgggtttaaccctaacgtttcgtaccgttcgttcggtcggggggaacccttccggg

SEQ ID NO: 408960 - DNA, 561 bp, Homo sapiens
  misc_feature: GZ8MTXP01EQ3AO.3.82.H05.1.454.CMB.2.raw
  modified_base (302)..(302): a, c, t, g, unknown or other
  modified_base (493)..(493): a, c, t, g, unknown or other
  modified_base (498)..(498): a, c, t, g, unknown or other
tcagagacgcactccacgaccggtgctcgatttagtcgagctctctcgcgggggggagaggagcccagcactgggattccgaggtgtttccattcggtgatcagcactgagcacagaggactcaccatggagttttggctgagctgggttttccttgttgctatttcaaaaggtgtccagtgtgaggtgcaggtggtggagactggaggaggcttgatccgagccgtggggggtccctgagactctcctgtgcagcctctggcttcaccgtcagtagcagctacatgcacgtcggggtcccnccgaggcctacgagggggaaggggctggaggtggtctcgtagtttattacaattctaggtaccactaatactctcccgacccgtgaacggccgtaactaaccatctccagacgacgattaccgagaacacggtgtatcttacaaatacgaaacactagagacgaccgacgacacggtactttatactgtgngaagnttagtcgagtgggtacgggccttcgacccgtggttctaacgttcgattcgtcgttcgggtccg

SEQ ID NO: 408961 - DNA, 718 bp, Homo sapiens
  misc_feature: GZ8MTXP01BESMC.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccgagccgtgggggtccctgagctctcctgtgcagcctctggcttcaccgtcagtagcagctacatcgcacgtcgggtcccgccaggcctaccggaagggggaacgggggctgggagtcgggtctacgtagtttatttactaactttcgtaggtaacccacgtacttaaaccgtacccgtccccggtaaccccggtacgggaaaccgggtacccgtaaacgttaaaccctacgttaccctacccgaagtaaccggtaaacgacgtttacccggaaacggtaaaccgtacgggtttacttaacttacccttaaacaaaagtttacgaaaacccctaacgggttggaaacggaccgacccggtaaaccgaccgtaccggggttacttttaaagtccgtggtacgacggaagtaagtaaccggtttggacggtttcggggttacccggacccttcgttacccgttcggtttcacgttcgacttcggacggtcggggccgtcg

SEQ ID NO: 408962 - DNA, 928 bp, Homo sapiens
  misc_feature: GZ8MTXP01D8V8B.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctattcaaaaggtgtccagtgtgaggtgcaggtggtggagacgtggaggaggcttgatccgagccgtgggggtcctgagactctcctgtgcagcctctggcttcaccgtcagtagcagctacagtcgcgtacgtcgggtcccgccgaggcctaccggaagggggaacgggggtcgtgggggaacggttgggggtaccttacgtaaggtttaacttttaaccgtaaaccgttttccgttacgggtaaacccctaaccgtaaccttaaaccccgttaaccccgttcccccgggtaaacccccgggttaacggggaaaccggggtaccccggttaaaacctttaaaccccgaacgtttccccgttacccgaaagggaaccggtaaaccggtaacgtttacccgggaaacggtaaaacccggttaacgggtttacggtttaaccttacctttaaaccgaaaaacgttaacggaaaaccccgtaaaccggggttagggaaaaccggggtaaccgacccccgggtaaaacggtaaaccccggttaacccggggtttacccggtttttaaacgtttaccgggttgggtacgggtacccggtaaaggggtaaacggttacgggtttaccggggtaaacgggggtttcccgggggtttaaccccgggggtaacccctttacccggttaaccccggttttcgggttttaacccctaccggttttccggtaccgtttcccggttccggggttccggggggttcccggttaaccccgggg

SEQ ID NO: 408963 - DNA, 659 bp, Homo sapiens
  misc_feature: GZ8MTXP01BFZ11.3.82.H05.1.454.CMB.2.raw
  modified_base (553)..(553): a, c, t, g, unknown or other
  modified_base (642)..(642): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctggtagggacagagtcgctatgtacttggtcgggcgtactcggtacggttttaacaggtagttggttagtcgtggtatcagcaagaaaccgagggaaacgccccctagtacgttccgtgtagtcgtctgcttagcctacgtccccaccgtgaactaaaggtcggacgtaccccaacgtcccgaagtacttcgacgtccgttacaaggtacgtaaacgttcggtacggggaacctaggtaacgtttcccacttctaccaaccctatccgaaacggtcctacggtccctaggcctaacgtccgtaaagtaacggttattttacgaaccttaactttaaccgttattacggacctaaagaccgggtnttaccggacttccggtccctcccgtacttccgttaacggttcgggaacgggtagaccgttagggttacgaatacggtaacaaacgggtnttcggtaacgcgtaacg

SEQ ID NO: 408964 - DNA, 871 bp, Homo sapiens
  misc_feature: GZ8MTXP01DOTJP.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtgggaggaggcttgatccgaggccgtgggggtccctgagactctcctgtgcacgcctctcggcttcaccgtcagtagcagctacagtcgcacgtgggtcccgccgagggcctaccggaagggggaacgggggcgtagggaggtcggggttcttacgtaagtttactttaacgtaactttccgttacggtaaccctactaacttaaacccttaacccgttccccggaaaccccggttcgggaaaccgggggtaccctaaaccttaaacccgacttccccgtaccgaaacggtaacgaaccggttaaccgtttcccggaaaagtaaaccgtaccggggtttagttaaaccttccgttaaaacaaacgtttaacgggaaacccctaaaccgggttaacgggaaaccggggaaccgtaaccccgggaaacggtaaaccccgttcggggttaaccccgttttttaaacgttaacggttcgggttacgggaacccgtaaggggtaaacgttaacgggttttacccgggtaggggtttaccgggggttttaccccgggggaacccctttaccccgggttacccggtttaccgggtttttcccttaaacccgggtttttcggaccgtttcccgggtttcccggggtccggggggggttccccgtttccccgggg

SEQ ID NO: 408965 - DNA, 650 bp, Homo sapiens
  misc_feature: GZ8MTXP01EMMR8.3.82.H05.1.454.CMB.2.raw
  modified_base (480)..(480): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccaggccgtgggggtccctgagactctcctgtgcacgcctgtcggtcttcaccgtcagtagcagctacatgcacgtcgggtccgccgaggcctccggaagggggtaagggggctgggtagtgggtctcgtagtttattactaacttcgtacgtaccatactaaacctacctcccggtaccccgtagggaaaccgggtccctaaactttaacccagtccctacgagaacggactacgttaccggaagtaaacgtacgggttntaacttacttaacgaaagtacgaaaccaacgtagaacggacgcccgaacgaccgtacggttacccgtttaagtactggtagacggaggtaacgtagttcgggacggttcgggtacgggtaccttcgttaccgttggttcctagtccgattccgcggtcggggcgtccggg

SEQ ID NO: 408966 - DNA, 635 bp, Homo sapiens
  misc_feature: GZ8MTXP01ATNO0.3.82.H05.1.454.CMB.2.raw
  modified_base (276)..(276): a, c, t, g, unknown or other
  modified_base (305)..(305): a, c, t, g, unknown or other
  modified_base (472)..(472): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtggaggaggcttgatccgagccgtgggggtccctgagactctcctgtgcagcctctggcttcaccgtnagtagcagctacatgcacgtcgggtaccnccgaggctaccggagggggagggcgtgggagttgggtctcgtagttacttacattcgtacgtacccaactactaacctaccgtacccgacccgttaggaacggggtccctaattaaacccattccgaccgacgacgtaacgacgttaccgaagtaacgtacgggttntaacttaccttaacgaaactacggggaaactaaccgtgaacggacgacccgacgaccgtaccggtcctttaatccgtggtgaacgtaagacgtagttcggtaaggttcgggttacgggccttccgtaacccttggttcctacgtcgttactcgttcggtcggg

SEQ ID NO: 408967 - DNA, 558 bp, Homo sapiens
  misc_feature: GZ8MTXP01AZWE7.3.82.H05.1.454.CMB.2.raw
  modified_base (358)..(358): a, c, t, g, unknown or other
  modified_base (417)..(417): a, c, t, g, unknown or other
  modified_base (422)..(422): a, c, t, g, unknown or other
  modified_base (479)..(479): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtcccgccaggctaccgagggggagggctgggagtgggtctcgagttacttacattctggtaccanactaactactcccgacccgtgaacgggctataaccatcaccagagacgatccgagaacncggtntactcttacaatcgaacactgagacgccgagactacggtctttatactgtgacgagngattcggtagttcgggtacgggtaccttcgttaccccgttggttccctacgtcgtactcgttacggtcggggccgtcgg

SEQ ID NO: 408968 - DNA, 703 bp, Homo sapiens
  misc_feature: GZ8MTXP01D3CMK.3.82.H05.1.454.CMB.2.raw
  modified_base (600)..(600): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagtcgttgggtttttccttgttgcttatttacaaaaggtgtccagtgtgaggtgcgaggtggtggagacgtggaggaggcttgactccgagccgtgggggtccctgagctctcctgtgcacgtcctcgtggcttcaccgtcagtagcagctacatgcacgtcggtcccgccgaggcctaccggaagggggaacgggggtcgtaggggtaggtcgggttaccttacgtaagtttaactttaacgtaaactttcgtacggtaacccactaacttaaacccttaacccgtccccggtaaccccgtagggaaacccggggtaccctaaactttaacccacttcccgtacccaagaacgtaaccgtacttaccggaagtaaaccgtcgggtattactacttaacaaatacgaaacaaccgtagacgacgaccgaacgaccgacgttactttaagtctgtgacgngaaattgttacggtaacggttcgggtacccgggtaccttacccgttccgtttcgggttccttaccgttcgtacttccggttcggtccgggggttccgtccggg

SEQ ID NO: 408969 - DNA, 779 bp, Homo sapiens
  misc_feature: GZ8MTXP01BMZA5.3.82.H05.1.454.CMB.2.raw
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtcctccatccctccgtgtctgcatcgtggtagggacagagtcgctatgtacgttggtccgggcgtacgttcggtacggttttaaacagtagttgggtttagtcgtaggtactacgaagacgaaacggaaaaccgagggggtaaaaccgtcccccgttaggtaaccgtttcccgtaggtattcggtccgtcggcctcggacctaaccttacccccgaaccccgtaggtaaaccgtaaaacgggtcggtaaccgttaccccctaagtaccccgtaaggtacctttacggaacggtccgttaaccgtaaagggtacgtaacgtcggtaacgggggaacacggggttacttaccactttacccaccctaacctatacgaagtccacgtccccgtgaacctaccggtacgttaagggttaaagtttacgttttaccgtaaaccgttaaactttttaacgttaagtttccgaaaccgaaacgggtcggtaccttaacgggaaccttccggtacccccttcccggtaccgttaacccgttcggggttcccgggacggggttaaacgggaccgtaagggttacgacttaacgtaacccgaaagtcggttggcgcttaacgctaac

SEQ ID NO: 408970 - DNA, 710 bp, Homo sapiens
  misc_feature: GZ8MTXP01D1BXS.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagtcttgggttttccttgttgctatttcaaaaggtgtcagtgtgaggtgcgaggtggtggagacgtgggaggaggcttggatccgaggccggtgggggtccctgacgtactctcctgtgcacgtcctcgtcggtcttccaccgtcagtacgcacgctacatcgcacgtcgggtccgccgacggccgtaccggaagggggaacgggggcgtaggggaggttcggggttaccttacgttaaggtttaactttaactaacgttcgttacggtaacctaactaacttaacctaacccgtccccggacccggtagggaaaccgggtaccgtaacttaacccgactaccgtaccgaagaacgtacgtacgttaccgaaagtaaccgtacgggttataactacgttaacaaagtacgaaaccacggtagaacgacgaccggaacgaccgtacggttacctttaatcgtgtcgacgaggtaagtcgttacggtacggttcggggttacccgggtccttaccgttccgttggtttcctacgttccgtagtcccggttaggtcccgggggcgtcccggg

SEQ ID NO: 408971 - DNA, 719 bp, Homo sapiens
  misc_feature: GZ8MTXP01AYX2H.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctcgtggcttcaccgtcagtagcagctacatgcacgtcgggtcccgccgaggcctccggaagggggaacgggggcgtagggaggttcggggtcttacgtaagtttaactttaactaactttccgtaggtaacccactaactaaacctacccgtcccggaaccccgtagggaaacgggtacccgtaattaaccacttccctaccgaagtaacgaacgtacgttacccggaagtaaaccgtacgggttataacttccttaaacaaaagttacgaaaacctaacccggtaggaaacggtaccgaccccggtaacgaaccgtaccgggttaccgttttaaataccgtggtacggaccgtaaggtaacggtaacgtttcgggaacggttcggggttaacccggggcccttcgaccccgttgggttaacctacgttcgagttccgttcgggtcggggttcccgtaaccgg

SEQ ID NO: 408972 - DNA, 785 bp, Homo sapiens
  misc_feature: GZ8MTXP01EHZYD.3.82.H05.1.454.CMB.2.raw
  modified_base (279)..(279): a, c, t, g, unknown or other
  modified_base (286)..(286): a, c, t, g, unknown or other
  modified_base (303)..(303): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccagccgtgggggtccctgagactctcctgtgcagcctctggcttcaccgtcagtancagctanatgcacgtcgggtcccnccgaggcctaccggagggggaacggggctggggaggtgggtctcgtagtttactttaactaatttcgtaggtacccaaactattaacctacctccccggacccgttagggaaacggggtcccgtaaactttaaacccgattcccgaccaaggaacgtaaccgtattaacccggaagtaaaccgtacgggtattacctactttaaacgaaaacgttacggaaaacctaaacccgttaggaacggaaaccggccccggaaaccgtaccggtaaacccggggttacccgttttttaacgtaacccgttggttcgggaaccgggtaaaggttacggttaaacgtttacccggggtaaaggggtttcccgggggtttaccccggggggttaacccttcccccgggttaaacccggtttcggggtttttaaccccttaacgttttaccccggttaagtttccccggtttccggggttccccggggggg

SEQ ID NO: 408973 - DNA, 677 bp, Homo sapiens
  misc_feature: GZ8MTXP01D6T1L.3.82.H05.1.454.CMB.2.raw
  modified_base (174)..(174): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtntccagtgtgaggtgcaggtggtggagactggaggaggcttgatcgagccgtgggggtccctgagacttctcctggtgcagcctctggcttcaaccgtcagtagcagctacatgcacgtcggggtccgccaggcgtccgaagggggaacgggggcgtgggaggttcgggtctcgagtttaattactaacttccgtaggtaacccactactaaccctactcccgacccgtgaaacgggcctacgttaaccatccgtaccaagtacgaacgtacttacccgaagaaccgtacggttgtaacttaccttacaaagttacgaaaccgtaaaccggtggaaacggacgacccggaacgtacccgtaacgggttacccgttttaagttaccgttggttacgacgggaagtaacggtagtttacgggcgggtttcggggttaccggggtaacccttccgttaaccccgttggtttcctacgtttcgacgttcgttcggtcgggcccgttgg

SEQ ID NO: 408974 - DNA, 541 bp, Homo sapiens
  misc_feature: GZ8MTXP01AV6G2.3.82.H05.1.454.CMB.2.raw
  modified_base (433)..(433): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgtacggttttaacagtatggttagtctggtatcagcaagaaaccagggaaacgcccctgagttcctgatgtctgctgcatccacctgacaagtgacgtcccatccagattcgagtctcaagtgaatcgtaggggacagtacgttcactctcaccatcagcacgcctgcagcctagaagtatttcgactaactttactattagtacaacgngactagactacgtcctcccgcttcctaacgtttcgggacgggacgggtaaccgaagggttcggagttacgtaaccgaaacgtaacgtggtacggacgtcgcctaaccg

SEQ ID NO: 408975 - DNA, 664 bp, Homo sapiens
  misc_feature: GZ8MTXP01AHWFJ.3.82.H05.1.454.CMB.2.raw
  modified_base (277)..(277): a, c, t, g, unknown or other
  modified_base (466)..(466): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccgagccgtgggggtccctgacgactctcctgtgcacgcctcgtggtcttcgaccgtnagtacgcagctacatcgcacgtcgggtcccgcgacggctaccggaggggacgggcgtgggaggtgggtctacgtagttattacacgttcgtagtaccactactaacctaccgtcccgacccgtaggaacgggtcctaattaaccactcctaccgaagacgacgtacgttaccgaagaaccgtacgggtntaacttaccgttacaaagttcgaaaccacggtaggacgtacggaccgtacgacgtacggtaccctttagtacgtcgtagccggtagtaacgtcgttacgggtaggttcggggtaccgggtaacccttcgttcccgtttcgggttaaccctacgttccggtaacttcccggttagggtccggggttcccgttaaccggg

SEQ ID NO: 408976 - DNA, 658 bp, Homo sapiens
  misc_feature: GZ8MTXP01D1W0H.3.82.H05.1.454.CMB.2.raw
  modified_base (521)..(521): a, c, t, g, unknown or other
tcagagacgcactccacgaccggtgctcgatttagtcgagctctctcgcggggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccgagccgtgggggtcctgagctctctgtgcagcctcgtcggtctcacgtcagtagcagctacatcgactacggtcgggtccgccgagggcctaccggaagggggacggggcgtgggaggtcgggtctacgtagttactttacgtaacgttctaggtaccactactaacctacccgtcccggtaaccccgtacgggtaaacgggacccgtaacttaaacccgcttacccgtacccaaggaacgtacgacgttaccggaagtaaacgtcgggttatacgttactaacaagtacaactacgngagaccgacgagaccgtcgttacgtttatcgtgtcgagtacgaatacgttcggaggttcgggtacccggtaccaccgttccggtttcggtaacctttaccgttcggcttcccggttcgggttcggggccggtttccg

SEQ ID NO: 408977 - DNA, 877 bp, Homo sapiens
  misc_feature: GZ8MTXP01CJ0MA.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtggaggaggcttgatccgagccgtgggggtcctgagactctcctgtgcacgcctcgtcggtcttcaccgtacagtagcagctacatcgcacgtcgggtccgccgaggcctaccggagggggaacgggggtcgtggggtaggtcgggtcttcgtaaggtttaactttaccaaagtttccgtacggtaacccaaacctaacttaacccgtaacccgtaccccgggtaacccccgggtaggaaaccggggtacccgtaaactttaaaccccgacttaccgtacccgaagggaaacggtacccggtaaacgtttaccccgggaaaggtaaacccggtaaccgggtttacgttaacgttaaccctttaaaccgaaaaacgttaaccgggaaaacgtaaaaccccggttacggaaaccgggaacccggaaccccggaaacccggtaaacccgttaacccggggttaaccccgtttttaacgtttaccgtagggttcggaaccggtaaagggttaaacgggtacgtttaccccggggttaaaggggttcccgggggttttaccccggggggttaacccctttaccccgggtttaaccccggtttcggggtttttaaccccgttaacccggttttacgggttacccgtttccgggttcccgggttaacccggggggg

SEQ ID NO: 408978 - DNA, 660 bp, Homo sapiens
  misc_feature: GZ8MTXP01B4QCL.3.82.H05.1.454.CMB.2.raw
  modified_base (479)..(479): a, c, t, g, unknown or other
  modified_base (486)..(486): a, c, t, g, unknown or other
  modified_base (555)..(555): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagtttggctgagctgggttttccttgttgctatttcaaaggtgtccagtgtgaggtgcgaggtggtggagactgggaggaggcttgatccagccgtgggggtcctgagactctctgtgcagcctctggcttcaccgtcagtagcagctacatgcacgtcgggtccgccgaggcctaccggaagggggaagggggctggggaggttcggggtactcgtaaggtttactttacgtaaactttccgttaggtaacccactactaaaccgttacccgtaaccccggtaaccccgtagggaaacggggacctaacgttaaccactctacagacgacgtatccgagaactcggtntatctanaatcaacacggtgaagcaccgacgacgtacgtctttataccgtgtgacgaggtaacgtgtttcccgggngggtttcggggtacccggggtacccttcccgttacccggtttggggtttaaccccttaacggttcgacctttcgggttccgggttccggggggccgttcccgggg

SEQ ID NO: 408979 - DNA, 674 bp, Homo sapiens
  misc_feature: GZ8MTXP01DZY7D.3.82.H05.1.454.CMB.2.raw
  modified_base (438)..(438): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtacctgagactctcctgtgcacgcctcgtggcttcaccgtcagtagcagctacatgcacgtcgggtccgccgagggcctaccggaagggggaacgggggcgtgggtaggtcggggttcttcgtaagtttatttaactaacttcgtacggtaccactactaaacctaaccgtcccgacccgtaggaaacgggtaccgaacttaacccntacctaccgaagacgtacgattaccggaaagaaacgtcgggttattaactacttaacaaatagaaaccaaccggtaggaacgaacgacccggaacgacgtaccggttccgttttaaattacgtggtagacgaaggtaagtagttcggaggtttcggggttaccggggtcccttaccggttcccgttgggtttaacctacgtttcgattcccgttcgggttcggggcccgttccggg

SEQ ID NO: 408980 - DNA, 694 bp, Homo sapiens
  misc_feature: GZ8MTXP01D1OT5.3.82.H05.1.454.CMB.2.raw
  modified_base (457)..(457): a, c, t, g, unknown or other
tcagagacgcactccacgaccggtgctcgatttagtcgagctctctcgcggggggggagaggagcccagcactgggattccgaggtgtttccattcggtgatcagcactgaacacagaggactcaccatggagttttggctgagtcttgggttttccttgttgcttatttacaaaaggtgtccagtgtgaggtgcgaggtggtggagacgtgggagggaggcttgactccgaggtccggtggggggtcccctgacgactctccgtgtgcacgcctcgtcggtcttcaccgtcagtagcagctacatcgcacgtcggtccgccgacggccgtaccggagggggacgggtcgtagggtaggtcgggtcttacgtaagtttacttaacgtaacttcgtacgtaaccactactaaccctaccgtcccggaacccgtaggaaccgggtacctaactaacccntacctacgaagacgtacgacttaccgaagtaaacgtggttatactactaaacaaactacaaacctacgtaggaacgtaccgaccgacgaaccgtacggttacgttttactcgtagacgtacggaaggtaagttcgttacgggtaacgggttccgggtaacccgggtccttacccgttccgtttgggttaaccttacgttcgtacgtccgttcggggtaacgggttcccgttaaccgg

SEQ ID NO: 408981 - DNA, 711 bp, Homo sapiens
  misc_feature: GZ8MTXP01EG1TJ.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctcgtggcttcaccgtcagtagcagctacatgcacgtcgggtcccgccgaggcctaccggaagggggaacgggggtcgtagggtaggtcggggtcttcgtaaggtttaactttaacgtaaactttcgtacggtaacccactaacttaaaccctacctccccggacccgtagggaaacgggacccgtaacttaacccattccctaccaaggtacgaaccgtacttacccggaaagtaaacccgtcgggttatacttacctaaacaaaagttcgaaaacctaaccggtgggaacgaaccggcccgaaacgaccgtaccgggttactttttaaatacgtggtcgaccgtaaggaacgttcgtttcggggaacggtttcgggggttacccgggaacccttccgttaccgtttgggtttaaccctacgttcggtactccggttcgtcggggggttccctcggg

SEQ ID NO: 408982 - DNA, 703 bp, Homo sapiens
  misc_feature: GZ8MTXP01CHAME.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccgccgaggcctccgagggggaggggcgtgggaggtgggtctacgtagtttactttaacaactttctggtaccctactactaacctaccgtcccggacccgtaggaaaccgggccgtaacttaaccgactacctacccgagtaacggacgtacttacccggaagtaaaccgtacgggtagttacttacgttactaaacgtcgaaacctaacggtggaaggtaccgacccgaacggtaacccgtaccggttacccgttttaataccgtgttacggacgtaacggtaagtacgtttcgggaacggttcgggggttacccggggtcccttaccggttccccgtttcgggtttaacccttccgtttaacggtcgttccggttcgggttcccgggggttccggttaacccggg

SEQ ID NO: 408983 - DNA, 723 bp, Homo sapiens
  misc_feature: GZ8MTXP01DC2DB.3.82.H05.1.454.CMB.2.raw
  modified_base (447)..(447): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcacgtcctcgtcggccttccgaccgtcagtagcacgtctacatcgactacgtcgggtcccgccgaggccgtaccggaagggggaacgggggtcgtaggggtaggtcgggttcctacgtaagtttattaactaacttcgtacggtaccactactaaccctacctcccggacccgtaggaacgggacctaacgtaaccnctccacctaagacgtacgtacttaccggaaagaacgtacgggttataacttacttaacaaagttaaccgaaaacccgtaaaccggttaggaacggaaccggaccccggtaaacgaacccggtaccgggtttaccttttaaacgtccgtaggttacggacgggaagtaacggtagtttcgggtaacggttcggggttacccgggtaccttacccggttacccgtttcggtttaaccttaccgttcgtacgtcgttcggtccggggttccgtaaccgg

SEQ ID NO: 408984 - DNA, 627 bp, Homo sapiens
  misc_feature: GZ8MTXP01B9I8X.3.82.H05.1.454.CMB.2.raw
  modified_base (487)..(487): a, c, t, g, unknown or other
  modified_base (543)..(543): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctattcaaaggtgtccagtgtgaggtgcaggtggtggagactggaggaggcttgatccagccgtgggggtccctgagactctcctgtgcagcctctggcttcaccgtcagtagcagctacatgcacgtcggtccgccgaggcctccgagggggaggggctgggagttgggtctcgtagtttacttacatttcgtggtaaccaacaacttaacctacctaccccggaccccggttaggaaccggggtacccctaatttaaacccgacttcctacccgagtaacgacgtacttaccggagaaacgtacgggtatactaccgttaaanaacgtacggaaactacgagacggacgccgacgacgtacggttacctttatacgtgnggaagagagtcgttcggtagggtcggttaccgggttccttccgtaaccgttgttaaccttacgtcgttcgtccgttcggtcggg

SEQ ID NO: 408985 - DNA, 953 bp, Homo sapiens
  misc_feature: GZ8MTXP01DGL3G.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtggaggaggcttgatccgagccgtgggggtccctgagactctctgtgcagcctctggcttcaccgtcagtagcagctacatgcacgtcgggtcccgccgaggcctaccggaagggggaacgggggtccgtaggggtaaggttcgggggttacttacgttaaggttttaacttttaaccgtaaacgtttccgttacgggttaaccctaacgtaacgtttaaaacccgttaacccgttaacccccgggtaaacccccgggttaaggggtaaaacccgggggtaccccgtaaaacctttaaaccccgaacgttaccccgttaacccgaaagggtaaacggtaaaccccggttaacgtttaccccggaaaacggtaaaaccccggttacggggttttaacgtttaaccttaaaccctttaaaccgaaaaaaacggtttacccgaaaaaaaccccgttaaacccgggggtttaggggaaaaaccggggttaacccggtttaaaccccgggaaaacccggttaaaccccggttaacccgggttttaaccccggttttttaaaagttcccggtttaaggggtacggaccggggtaaaaggttaaacggttacggtttcggggtaaacggggtttcccggggggttaaccccggggtaaccctttaccccggtttacccggtttacgggttttcccttaaaccgggtttccggacgtttcccggttaccgggggtccgggggttccccgttccggg

SEQ ID NO: 408986 - DNA, 627 bp, Homo sapiens
  misc_feature: GZ8MTXP01DYSAM.3.82.H05.1.454.CMB.2.raw
  modified_base (467)..(467): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccgagccgtgggggtccctgagactctcctgtgcagcctctggcttcaccgtcagtagcagctacatgcacgtcgggtcccgccgaggcctaccggagggggaaggggcgtgggagtgggtctacgtagttatttactattctagtaccatactaacctaccgtcccgacccgtaggaacggactactaaccgatacctaccagtacgacgacttacgaagaacctcggtatactacttacgaaatanaaaccaacgtgaagacgacccgaacgaaccgtcgtaccgtttaaatccgtgtagacggaggtaatacgttggacgggttcgggtaccgggtcccttaccgttccgttcgggtttaactaccgtttcgacttccggttcggtccgggggttccgtcccggg

SEQ ID NO: 408987 - DNA, 596 bp, Homo sapiens
  misc_feature: GZ8MTXP01EXYGL.3.82.H05.1.454.CMB.2.raw
  modified_base (401)..(401): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagggtggtggagacgtggagggaggcttgatccagccgtggggggtccctgagactctcctgtgcagcctctggcttcaccgtcagtagcagctacatgcacgtcggccgccaggctccggaggggaggggtcgtgggagtgggtctcgtagtttactttacattctaggtaccaatactctacctccgacccgtaggacggtccgtanaccactctcagagacgataccgatacacggtatacgtacttacaatacgaacacgtagacgacgaccgacgaccgaccggtaccgttagtaccgtgtcgcggtagacggtagttacggtacggggtttttccgggggacccgttccgtaaccccgtcggttccgttaccgtttcgttactccgttccgtcggggg

SEQ ID NO: 408988 - DNA, 726 bp, Homo sapiens
  misc_feature: GZ8MTXP01EC3NT.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagtcgttgggttttccttgttgctatttacgaaaaggtgtccagtgtgaggtgcgaggtggtggagacgtgggaggaggcttgactccgacggccggtcgggggtccctgacgtactctccgtgtcgcgacgtcctcgtcggtcttccgaccgtcgagtacgcacgactacagtgcctacggtcggtccgccgacggtaccgtaccgggaagggacggggtcgtagggtacggtcggttcgtacgttagtttaactttacgtaaccgttcgtacgtacctacgtaacttaaccgtacccgtcccggtacccgtagggaaaccggacctaacgttaaccactaccgtacgaagacgtaactacgtaaccggaagtaaaccgtagtacttactacttaacaaacgtaacgaaaccgtacgtaggaacgtacgacccgacgtaaccgtcggttacttagtactgggactacggaaagtgttacggttcgggtaacgggttcccgggttcgggtaacccttccggttaccggttccgttaacgtacgttcgtcgttaccgggttcggttaaccggggttcccgtccggg

SEQ ID NO: 408989 - DNA, 636 bp, Homo sapiens
  misc_feature: GZ8MTXP01AJHJ9.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggagcttgatccagccgtgggggtccctgagactctcctgtgcagcctcgtcggcttcaccgtcagtagcagctacatgcacgtcgggtcccgccgaggcctccggagggggaacgggggcgtgggaggtgggtctcgtagttatttacattcgtgtacccactactaacctacctcccgaccccgtaggaacgggccgtaattaaccatcctaccgagacgacgacgttccgaagaacgacggttagtacttacttacaaagtcgaaaccaacgtgaacgacgaccggaacgaccgaccggttaccgtttaattaccgtggtacggacgaggaagtcgttacgggtaggttcggggttaccggggcccttccgttccccgttgggttaacctacgttcgacgtccgttcggtcggggttcccgtcggg

SEQ ID NO: 408990 - DNA, 611 bp, Homo sapiens
  misc_feature: GZ8MTXP01ATK8L.3.82.H05.1.454.CMB.2.raw
  modified_base (287)..(287): a, c, t, g, unknown or other
  modified_base (393)..(393): a, c, t, g, unknown or other
  modified_base (397)..(397): a, c, t, g, unknown or other
tcagagacgcactccacgaccggtgctcgatttagtcgagctctctcgcgggggagtcagacccagtcaggacacagcatggacatgagggtctccgctcagctcctggggctcctgctgctctggttcccaggttccagatgcgacatccagatgacccagtctccatcctccgtgtctgcatcgtggtaggggacagagtcgcttaataacgttggcgggcgactcgtacgttttaacagtattggttagtctaggtactcagacaacggaaaccgagggaaacnccctagtacgttcctgatgtctgctgcactcccacctgacaagtgactccatccagtacttcgacgtcgtacaagttcgaatccgtagggacagtcgttcacttcncacntcagcagcctgcagtcctagtaattactttcactaactttaggtaattcgaaacaaccgtgtactacgtacctccgttccctcccgtcttaaccgttccgggttacggggaccggggttaaacggtaaccggtaaggggttacgttaaacgaaccgtaaacccggaaacggttaacgttacgggtaccggttacctaaccggttaaccctaacg

SEQ ID NO: 408991 - DNA, 689 bp, Homo sapiens
  misc_feature: GZ8MTXP01A3Q0S.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggtttttccttgttgcttatttacaaaaggtgtccagtgtgaggtgcgaggtggtggagacgtggaggaggcttgatccagccgtgggggtccctgagactctccgtgtgcagcctcgtggccttcgaccgtcagtagcagctacatgccacgtcgggtcccgccgaggctaccgagggggaacggggcgtgggagttggggtctagtagtttatttacaacttcgtaggtaccactactaaaccctaccgtcccgaccccggtggaaacgggccctaattaaccactcctaccaagacgaacgacgttaccgaagtaaccacgggttagtaacttcttaaacaaaagttcgaaaaccaaccgtagaacggaccgacccgacggtaaccgaccgggttaccgttttaattaccgtaggttcgacggtaacggtaagtaacgtttagggtaacgggttcggggttacccggggtaacccttccggacccgtttcgggttaaccttacgttcgtacgttcgttacggtcggggttccgttccgg

SEQ ID NO: 408992 - DNA, 811 bp, Homo sapiens
  misc_feature: GZ8MTXP01BOJ8O.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagtcttgggttttccttgttgctatttcaaaaggtgtccagtgtgaggtgcgaggtggtggagacgtggaggaggcttgatccgaggccgtgggggtccctgagtactctctgtgcagtcctcgtggccttcaccgtcagtagcagctacagtcgcacgtcgggtccgccgagggcctaccggaagggggaagggggtccgtagggaggttcgggggttaccttacgtaaggtttaacttttacgtaaaccgtttcgtacgggtaaccctaactaacgttaaaccccttaacccgtccccggaaaccccccgggttaggaaacccgggggtaccccctaaacgtttaaaaccccatttacccccgtacccgtaaaggaaaccggtaaccggtaacgtttaccccggaaacgtaaaaccggtccggggtttacttaacttacccgttaaacaaaacgttaacggaaacccctaaaccgggtaggaacggtaaccgaccccggggtaactaaacccggtacccgggtttaaccgttttaacgttaccgtgggttacgaccggaaaggtaacggttaagtttccggggaggtttcggggttacccgggaaccttccgttaccccgtttgggttaaccttacgttcgacgtcgttcggtaacgggccgtttccg

SEQ ID NO: 408993 - DNA, 771 bp, Homo sapiens
  misc_feature: GZ8MTXP01DC163.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagacgtgggagggaggtcttgactccgaggtccggttcggggggtccctggacgtacctctcccgtgtcgcacgtcctgtcggtccttcgaccgtgagtagcagtctacatcgctacgtccgggtcccgccgagggccgtaccggaagggggaacggggcgtaggggtaggtcgggtcttacgttagtttattactaactttcgtacggtaccaactacttaacccgtacccgtcccggacccggtagggaaaccgggtacctaaccttaacactccgtacgaagacgtacgtacgttaccggaaagtaacgtcggttattaactacttaaacgaaagtacgaaaaccctacgggtaggaacggaaccggtacccggaacgtaacccggtaccggtttaccgtttttaaactcggttcggtacggtaccgtaagggtaagtttccgggttacgggggtaacgggtttcccggggggttaccccgggtaccccttacccggttccgtttacgggtttcccttaacggttcgtaacgttccgttaccgggggtccggggttaacccgttccgggg

SEQ ID NO: 408994 - DNA, 695 bp, Homo sapiens
  misc_feature: GZ8MTXP01BDQUQ.3.82.H05.1.454.CMB.2.raw
  modified_base (252)..(252): a, c, t, g, unknown or other
  modified_base (254)..(254): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtcagtgtgaggtgcaggtggtggagacgtggaggaggcttgatccagccgtgggggtcctgacgactctctgtncngcctgtggcttcaccgtcagtagcagtctacatcgcacgtcgggtccgccgacggccgtaccggaagggggacggggcgtgggaggttcgggttactcgttaagtttacttttaacgaaactttccgtacggtaaccctaaactaacgttaaccctacccgttaccccggaaccccgggtagggtaaaccggggtacccgtaaactttaaacccacgtttacctaccggaaaggaacgtaaccggtactttaccccgggaaagtaaccgtacggggttattactacgttaacaaaagttcgaaaacctaaccggttagacgacggacccgacgtacgtaacggtctttaatcgtaggtgaacagttcgtaggttcgacggttcgggttaccgggccttccgaaccgttggttcttcgtcttacgttcgttcgggtccgggg

SEQ ID NO: 408995 - DNA, 703 bp, Homo sapiens
  misc_feature: GZ8MTXP01BR9EK.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagtcttgggtttttccttgttgctatttacaaaaggtgtccagtgtgaggtgcgaggtggtggagacgtggaggaggcttgatccgaggccggtcgggggtccctgacgtactctccgtgtcgcacgtcctcgtcggtcttccgaccgtcgagtagctagactacagtcgcctacggtcgggtcccgacgacggccgtacgggaaggggacgggggtcgtagggtaggttcgggtctacgtagtttactttacaacgttcgtacgtaccactactaaaccctccgtcccggacccgtagggaaccgggtcctaacttaacgactcctaccgaagtacgacgtacgtaccggagtaaaccgtgttctaactctaaacaactacgaaacctacgggtgaacgacgacccgtaacgtacccgtacggtttacctttaagtcgtcggtacggacggaggtaacgttacggttccgggtaagggttcccggggttacccgggacccttcccgttaccgttgggttcccttcggtaacgtctcgggttcggtccggggttccgtccgg

SEQ ID NO: 408996 - DNA, 960 bp, Homo sapiens
  misc_feature: GZ8MTXP01ESO9C.3.82.H05.1.454.CMB.2.raw
  modified_base (238)..(238): a, c, t, g, unknown or other
  modified_base (242)..(242): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtggggggtcccngacnctctcgtgtcacacgtcctgtcggtcttaccgaccgtgagtgacacgtacctacgtacgtacgtaccgtaccgggtcccgggtaccccggacccgggaccggtaccgggtacgggggaacgggggtaacgggggtacgggtcggtaacgggttagggggttaccgtttaccttaaacggttttaaaagtttttaacccgttaacgtttacccgttacgggttaaacccgtaaaccctaaccgttaacccgttaaaccccgttaccccgggtaaaccccccgggttaacccggtaaaacggggtaaccccggtaaactttaaaaccccgtaaaccgttaacccgttaccccgtaaacggtaacggtaaacccggaaaccgttaacccggtaaacgggtaaaccgtaaaccgggggtttacggttaaacgttaaaccgtttaacccgtaaaaacgttaaaccggtaaaaccgtaaaaccccggttaaccggtaaaccgggtaaaccgggaaccccgggtaaaccccgggtaaaccccggttaaacccggggttaaccccggtttttaaaccggtttaaaccggttacgggttacgggtaacggttaacgggttaacggggttaacgggtttaaccggggttacggggttaaccgggggtttacccggggggtaaccccggttacccggttaacccccggtttaaccggggttttaacccg

SEQ ID NO: 408997 - DNA, 580 bp, Homo sapiens
  misc_feature: GZ8MTXP01B87PU.3.82.H05.1.454.CMB.2.raw
  modified_base (258)..(258): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctntggcttcaccgtcagtagcagctacatgcactgggtccgccgaggctccgagggggaaggggcgtgggagtgggtctctagttatttacattctggtaccactataacctactcccgacccgtgaacgggtccgattaaccatcctccaagacgacgattcccggaagaaacgacggtagtactcttacaaatgaaacacgtgagacgcccgacgaccaccggtcgtttaatcgtgtgcgagaagtcgttcggcggttgggtccggggccttccgcccgttgggttctacgtcgtactcgttcggtcggggttcccgtcggg

SEQ ID NO: 408998 - DNA, 781 bp, Homo sapiens
  misc_feature: GZ8MTXP01ADXN7.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtggaggaggcttgatccgagccgtgggggtcctgacgactctcctgtgcacgcctcgtcggcttcaccgtcagtagcagctacagtcgcacgtcgggtccgccgacggctaccggagggggaacgggggcgtagggacggttggggtacttacgtaagttttaactttaacgtaaccgtttcgtacggtaacctaccgtaacttaaacccttaccgtccccggaaccccggttagggaaacggggtacccgtaaactttaaacccgacttaccgtacccgtaaaggaacgtaccggtaacgtttacccggaaagtaaacccgtacggggtttattaaaccttaccttaaacgaaaacgtaccgtaaaaccgaaccgtttaggggaaacgaccggtaaccccggaaacggtaaccgtaccggggtttaccttttaagtaaccgtggtacggacgtaggtaatcggttacgggtacggttcgggggttaccgggtaacccttccggttacccgttttaggggttccttaaccggtttcggtcttccgggttccgggtcgggggttaacccgtcccggg

SEQ ID NO: 408999 - DNA, 643 bp, Homo sapiens
  misc_feature: GZ8MTXP01B7ZMU.3.82.H05.1.454.CMB.2.raw
  modified_base (429)..(429): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtggaggaggcttgatccagccgtggggggtccctgagactctcctgtgcacgcctctggtcttcaccgtcagtagcagctacatcgcacgtcgggccgccgaggcctaccggagggggacggggcgtgggagtcggggtctcgtagtttatttactaacttcgtacggtacccacgtactaaccgtacccgtcccgaccccgtagaacgggtcctaattaaccntcctaccagacgacgtactacgagaacgtacggttatactacgttacaagtagaaaccacggtagacgtacgaccgacgacgtaccggtactttagtactggtacgcgaggtaagtgttacggtcgggttcgggttaccggggaccccttaccggttcccgttacgggtttctaccgttcgtcgttccgttcggggtcggggttcccggtccgg

SEQ ID NO: 409000 - DNA, 677 bp, Homo sapiens
  misc_feature: GZ8MTXP01DOP2B.3.82.H05.1.454.CMB.2.raw
  modified_base (243)..(243): a, c, t, g, unknown or other
  modified_base (330)..(330): a, c, t, g, unknown or other
  modified_base (396)..(396): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagtttggctgagctgggtttccttgttgctatttcaaaaggtgtccagtgtgaggtgcaggtggtggagactggagaggcttgatccagccgtgggggtccctgagactcncctgtgcagcctctggcttcaccgtcagtagcagctacatgacacgtggtccgccgaggctccgaaggggagggctggagtggtctnagtttattacaattctaggtacaactatctactacccgacccgtagaacgggccaaattaaacccntacacgaagacgtacgtacgtaaccggaagaacgtacgggttacttaaactcttaaacaaacgtaacggtaaaccgtaaaccgtaacgaacggaaccgaacccggaaccggtaaccggtaaaccggttaaccgtttaacgttaacgttacggtacggtaacggtaacggttaacggtacggttacggttacgggttacggggttaccggggttacccggttacccgtaacccgttaccgtttaaccgttaccgttaccgttacgttccgttcgggtcgggg

SEQ ID NO: 409001 - DNA, 601 bp, Homo sapiens
  misc_feature: GZ8MTXP01B5GVG.3.82.H05.1.454.CMB.2.raw
  modified_base (301)..(301): a, c, t, g, unknown or other
  modified_base (354)..(354): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatcgtggtaggggacagagtcgctatgacttgtcgggcgacgtcgtacggttttaacagtatggttagtctggtatcagacaacgaaaccgagggaaacgcccctggacgttccngatgtctgctgcactcccacctgacaaagtggactccatccagtatcagctcngtgaatcgtagggacagtatcactctacacatcagcacgctgacacgcctagtaagttattttcgaacttaaactttactagtttacgaccgaacgtacggtctagaccctacggttccctccccgtctttacccggtaccgtttcccgggggaacggtaacggggttaacccgttaaaggggttacgggaaacgttaacgtaaccgtaaaaaccgggacgtttacgggtaacggttccgtaaccgg

SEQ ID NO: 409002 - DNA, 673 bp, Homo sapiens
  misc_feature: GZ8MTXP01CXYHI.3.82.H05.1.454.CMB.2.raw
  modified_base (467)..(467): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagtcttgggttttccttgttgctatttacaaaaggtgtccagtgtggaggtgcgaggtggtggagacgtgggaggaggcttgatccgagccggtcgggggtcctgacgactctcctgtcgcacgcctctggtcttcgaccgtcagtagcagtctacatgccgtacgtcgggtcccgccgacggccgtaccgggaagggggaacggggtcggtaggggaggttcgggtacttacgttagtttaactttaacgtacttcgtacgtacccaactaactaaccgtaccgtacccgtacccgggtagaacgggaccgtaactaaacccnttcctacgagacgaaccgtacttacgaacgaacgtcggttatactacttaacaaacgtagaaacctacgtacgacgacgaccgacgacgtaacgggtccttaagtcgtgtcgaacgtagagttcgttcggtacgggttcgggttaccgggccttccggtaacccgtttgttccgttacgtcgttacttccggttcgggtcccgggg

SEQ ID NO: 409003 - DNA, 904 bp, Homo sapiens
  misc_feature: GZ8MTXP01EZ914.3.82.H05.1.454.CMB.2.raw
tcagagacgcactccacgaccggtgctcgatttagtcgagctctctcgcggggggggagaggagcccagcactgggattccgaggtgtttccattcggtgatcagcactgaacacagaggactcaccatggagttttggctgagctgggttttccttgttgctattcaaaaggtgtccagtgtgaggtgcaggtggtggagacgtggaggaggcttgatccagtccgtgggggtcctgagactctcctgtgcacgtcctcgtggcttcgaccgtcagtagcagactacagtcgacacggtcgggtacccgccacgggtccgtacccggaagggggaacgggggtcctagggggtacggttcgggggtaccttaccgtaaagtttacgtttaaccgtaacgtttccgtacgggtaaccctaactaacgtaaacccgttacccgtaaccccgggtaacccccggttagggaaaccggggtaccccgttaaaacgtttaaaccccacgttaccccgtacccgaaagggtaccggtaaaccggtaacgttacccgggaaagtaaaaccccggttaggggtttactaacgtttaaccgttaaactaaaaagttaccgggaaaacccgttaaaccggggttaggaaaccggggtaccggtaaacccgggaaccggtaaacccgtaccggggttttaccggttttaaaacttacccgtagggggttacgaaccgggtaagggtaaaccgggtttacgtttaccgggggaacgggggtttacccgggggtttacccgggggaaacccccttcgggttaaacccccggttttgggggtttaaccccttaacggtttccggtaacgttccgggttacccggggttccggggggttaacccctttaacccggggg

SEQ ID NO: 409004 - DNA, 744 bp, Homo sapiens
  misc_feature: GZ8MTXP01CK5JB.3.82.H05.1.454.CMB.2.raw
  modified_base (649)..(649): a, c, t, g, unknown or other
  modified_base (669)..(669): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggtagttttggctgagtcttgggttttccttgttgcttatttcaaaaggtgtccagtgtgaggtgcgagggtggtggagacgtgggaggaggcttgactccgaggtccggtcggggggtccctgacgtacctccttccgtgtcgccacgtcccttcgtcggtccttccgacccgtacgaggtacgcacgtactacagtcgccgtaccggttccgggtccccgaccggacggtccgtacccgggaaggggggaacgggggtcgtaggggtacggttcgggttacgtacgttaagtttaacctttaacgtacgtttcgtacggtaaccctaaactactaaccgtacccgtacccggacccgtagggaaccggtaccgtaactaacccgctaccgaccgaaggaccgtacgtaacgtacccggaaagtaaccgtcgggtattaactacctaagtaaaacgacggtaaaccacggtaggaacggacccgaaccccgtacgtaacgtacccggttaccttttanacgtgggtcgaacgtaaggngtttaggccgtaggggttcgggttaccgacccttccgtaaccgttggttctacgttcgacttcggcgggtccggg

SEQ ID NO: 409005 - DNA, 644 bp, Homo sapiens
  misc_feature: GZ8MTXP01CFSX4.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcacgcctctggcttcaccgtcagtagcagctacatcgcaccgtcggggtcccgccgaggccgtaccggagggggaacgggggcgtgggaggtggggttctacgtaagtttattactaacttcgtaggtaccctactactaacctacccgtcccggaccccggtagggaaccgggtcccgtaacttaacccgactccctaccgagacgacgtacgttaccgaagtaaaccgtcgggtagttactacttaacaaacgtacgaaacctaaccggtgacggacgccggacgtacgcggtcctttaatcgtgtgacgagtaagcgttggagttcgggtaccgggacccttcgttaccgttggttcctacgttcgcttcgttcggtcggggcctccggg

SEQ ID NO: 409006 - DNA, 815 bp, Homo sapiens
  misc_feature: GZ8MTXP01EU038.3.82.H05.1.454.CMB.2.raw
  modified_base (320)..(320): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggtagttttggctgagtcgttgggttttccttgttgcttatttacaaaaggtgtccagtgtgaggtgcgaggtggtggagacgtggaggaggtcttgacgtccgaggtccggttcggggggtccctggacgtacttcgtccgtggtcgtacgcctcgtcggtccttccaccgtctaggtacgcagctacngtcgcacggtcgggtcccgcgtacggccgtaaccgggagggggtacgggcgtagggtagggtcggttactacgttaagttttactttaaccgtacgtttacgtacggtaacctaccgtaaaccttacccgttaacccgtccccggtaaccccgggtagggtaaaccggggtaccccttaaacgttaaccctacttaccccgtaacgaacggtaccgggtaacctaagttcccggaaaaagtacccgtagggtttacttaactacccgttaaaaagaaacgtaaccgtaaaccggtaacgtagggaaccgtacccggaacccgtaaccgtaccggtttacggtttactttaacgtcgtacgggacggtaacggtaagttaacggttacggttacgggttaccgggttacccgggggttacccgttacccttcccggttaccggttcgttaccttaacggttaccggcgttccgggttccggggttcccgggtcccg

SEQ ID NO: 409007 - DNA, 744 bp, Homo sapiens
  misc_feature: GZ8MTXP01EPWZQ.3.82.H05.1.454.CMB.2.raw
tcagagacgcactccacgaccggtgctcgatttagtcgagctctctcgcggggggggagaggagcccagcactgggattccgaggtgtttccattcggtgatcagcactgaacacagaggactcaccatggtagttttggctgagtcgttgggttttccttgttgcttatttacaaaaggtgtccagtgtgaggtgcgaggtggtggagagtggaggaggcttgatccgaggccggtcgggggtcctgacgactctcgtgtgcacgtcctcgtcggtccttcgaccgtcagtacgcagctacagtcgcacgtcgggtcccgccgaggccgtaccggaagggggacgggggtcgtggggtaggttcgggttacttacgttaagtttaactttaacgtaaacgtttccgtacggtaaccctaactacttaaaccctaacccgtccccggaccccggtaagggaaaccgggtaccgtaaacttaacccgacttacccgtaccgaaggaacgtaaccgtacgttacccggaaagtaaacccgtacgggttataactacttaaacaaagtacgaaaccaacggtgaaacgaccgaacccggaacgtaaccgtaccgggttacttttaaatcgtggtacgacggtaaggtaagttcgtttcgggacgggtttcggggtacccgggtaacccttccgttacccgtttaggtttcccacgttcgtactcggttacggtccggggttccgtcg

SEQ ID NO: 409008 - DNA, 644 bp, Homo sapiens
  misc_feature: GZ8MTXP01DXU4U.3.82.H05.1.454.CMB.2.raw
  modified_base (251)..(251): a, c, t, g, unknown or other
  modified_base (253)..(253): a, c, t, g, unknown or other
  modified_base (263)..(263): a, c, t, g, unknown or other
  modified_base (270)..(270): a, c, t, g, unknown or other
  modified_base (273)..(273): a, c, t, g, unknown or other
  modified_base (277)..(278): a, c, t, g, unknown or other
  modified_base (281)..(281): a, c, t, g, unknown or other
  modified_base (305)..(305): a, c, t, g, unknown or other
  modified_base (310)..(310): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcgtggttttcgtgtaggctattacaaaaggtgtccagtgtgaggtgcaggtggtggagctggaggaggcttgatccagccgtggggggtccctgagctctcctgtgcncnctctgtctcnctcagancancacnngcncgtcggcgcgcgcgcgagggaggngtggngtgtgttggtagttgtagtacgtgggtacgggtaaccgtacctaccgtaacccgtacctcgtacgtacgtacgtacgtacactactactactactactacgtacaactaactacttacctacctacaactactactactacgtacggaccgaccgacacgacgtacgttcgttacgtttacgtttagttacggttacggtaccggttacggttaacggttacggttacggttacgggttacgggtaccgggtaacgggttaccggttccggttaccgtaaccgttaccgttcccgtaccgtaccgttacccgtaacccgaacccggtaacccgg

SEQ ID NO: 409009 - DNA, 918 bp, Homo sapiens
  misc_feature: GZ8MTXP01CMM37.3.82.H05.1.454.CMB.2.raw
  modified_base (306)..(306): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggtagttttggctgagtcgttgggttttccttgttgtcttatttacaaaaggtgtccagtgtgaggtgcgaggtggtggagacgtgggaggagtcttgactccgaggtccggtgggggtccctagacgtactctctgtcgcacgcctcgtcggtcttccacgtcagtagcagctanatcgctacgtcggtccgcgacggtccgtacggaagggggtaacggggtcgtaggggtacggttcgggttcttacgttaaggttttaacttaaccgtagtttccgtaacggtaaccctaaacttaaccttaacccgtacccggtaccccgggtaacccccgggtagggtaaacccggggtaccccgttaaacttaaaccccgacgtttacccgaccgggaaaacgtaccgggtaaaccgttaacccggttaaccggaaacggtaaaccccgttagggtttaagttaaccctttaaaccgttaaacgtaaaaacgttaaccgggaaaacccgtaaaccggttcgggaaaccggaaacccggtaaccccgggtaaaacccgtaacccgggtttaaccccgggttttaacccgtttttaaaaggttcccggttaagggttccgggtaaacccgggtaaaggttaccgggttttaacgggttacccggggtttaaacgggggtttcccggggggtttaacccccgggaccttttacccccggtaaaccgggttttccgttttaacccgtaaccgtttccgggaaccgtttcccggttaacgggggttcccccggggg

SEQ ID NO: 409010 - DNA, 696 bp, Homo sapiens
  misc_feature: GZ8MTXP01BU9D6.3.82.H05.1.454.CMB.2.raw
  modified_base (274)..(274): a, c, t, g, unknown or other
  modified_base (303)..(303): a, c, t, g, unknown or other
  modified_base (525)..(525): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgacgactctcctgtgcagcctctggcttcaccgtnagtagcagctacatgcacgtcgggtcccncgaggctaccggaggggaggggctgggagtgggtctgtagtttactttactaatttcgtacgtaccaactacttaacctacctccccggaaccccggtggaaaccggggtccgtaaattaacccacttcctaccgaaggacgtaacgtacgttaacccggaagtaaaccgtacgggttagttaacttaccgttaacaaaacgtacggggaaaccctaaccgnggaaacggaccggccccggaaacgtacccgtaaccgggtttcctttaacttaccggtgttacggaacgaaggttagtacgtttcgggaacgggtttggggttccccggggaccttcccgtaaccccgtttgggtttcccttaccgttcggactttcgttccgggtcggggg

SEQ ID NO: 409011 - DNA, 901 bp, Homo sapiens
  misc_feature: GZ8MTXP01B0QKB.3.82.H05.1.454.CMB.2.raw
  modified_base (257)..(257): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtcctgagactctcctgtgcagcctntggcttcacgtcagtagcagctacatgcacgtcgggtccgccgtaggccgtaccggaagggggaacgggggtcgtaggggaggttgggggttaccttcgtaaggttttaactttaaccgtaaactttccgttacgggtaaacctaaccgtaacttaaaccctaacccgtccccggaaacccccggtagggtaaaaccggggtaccccggtaaaacctttaaaaccccgacttacccccgtaaccgtaaagtaaaccgggtaaccggtaacgtttaacccccggggaaaagtaaaaccccggtaccgggggttttaagttaaacctttaccgttaaaccgtaaaaaaactttacggggaaaaacccctaaaaccccgggggtttaggtaaacccggggaaacggtaaccccccggggaaaccgggtaaaacccccgggtaaccggggtttaacccccgttttttaaaaggtttaaacccggttggggtaacccgttaacggggaaacggtaaaggggttaaccgtttaccggggtaaacggggtttcgggggttaacccgggggtacccttacccgttaccccgggtttgggttaaccttaccgttaacgtactccggttcgggttccgggggaaccgttccggg

SEQ ID NO: 409012 - DNA, 739 bp, Homo sapiens
  misc_feature: GZ8MTXP01B6GFN.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctctgtgcagcctcgtcggcttcaccgtcagtagcagctaacatcgcacgtcgggtcccgccgagggccgtaccggaagggggaacgggggtcgtagggaggttcgggggttcttacgtaaggtttaactttaactaactttccgtacggtaacccaactacttaaaccctaccgtcccggtaacccgtagggaaccgggaccgtaacttaaccactcctaccgaagacgacgtacttaccggaaagtaaaccgtacgggttagtacttaccttaacaaaagtacgaaacccgtaaacggttaggaaacggaccggaccccggaaacggtaacccgtacccggggttaacctttttaacgtaccgttgggtacgaccggtaaggtaacgttaacggtttcgggtacgggtttcggggttacccggggtacccttacccggttcccgttacggtttccttacgttcgtacgttccgttacggtcgggggcccttaagg

SEQ ID NO: 409013 - DNA, 800 bp, Homo sapiens
  misc_feature: GZ8MTXP01EXAGA.3.82.H05.1.454.CMB.2.raw
  modified_base (306)..(306): a, c, t, g, unknown or other
  modified_base (526)..(526): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagactggaggaggcttgactccagccgtgggggtccctgagactctcctgtgcagcctctcggtcttcaccgtcagtagcagctacagtgactacgtcgggtcccnccgacggctccggaagggggacgggggcgtgggaggttcgggtctacgttagtttaactttactaacttcgtacggtaaccaactacttaaaccctacccgtccccggtaaccccggtagggaaaccggggtaccctaaacgtttaaacccgacttacccgttacccgaaggtaccgaaccggtacttaccccgggaaaggtaaacccgtacggggtttnttaacttaccgttaacaaaaagtaccgtaaaacccgtaaccgggtacgggaaacgtaccggaaccccggtaaacggtaaaccccgtaaccggggtttaccgtttttaaacgttacccgttagggttaccggaccgggaaaggtaacggttaagttttaccggggaacgggtttcgggggttacccggggtccccttacccgtttacccgttcgggttttaacccgttacttccgggtacttcccggttcgggtccgggggttcccgtcccgggg

SEQ ID NO: 409014 - DNA, 660 bp, Homo sapiens
  misc_feature: GZ8MTXP01EZKBH.3.82.H05.1.454.CMB.2.raw
  modified_base (277)..(277): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcacgcctcgtcggtccttcacccgtnagtagcagctacatgcacgtcgggtcccgcaggcctccgagggggaaggggctgggagttggggtcttcgtagtttatttacgaactttcgtaggtacccactaactaacctaccgtcccgacccgtaggaaacgggccgtaacttaaaccatcctaccgagaacgacgtaacttaccggaagtaaacgacgggttataacttcgttaacaaacgtacgaaaccaaccggtggaacgtaacgcccgaacgaccgtacggtactttaatacgtgtcgacgagtaagtaacgttcggtaggttcggggttaccggggtacccttaccgttcccgttacgggttcctacgttccgtacgtcgttcggtaacggggttccgttccgg

SEQ ID NO: 409015 - DNA, 673 bp, Homo sapiens
  misc_feature: GZ8MTXP01BAV5Y.3.82.H05.1.454.CMB.2.raw
  modified_base (311)..(311): a, c, t, g, unknown or other
  modified_base (431)..(431): a, c, t, g, unknown or other
tcagagacgcactccacgaccggtgctcgatttagtcgagctctctcgcggggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtgggaggaggcttgatccgagtcgtggggggtccctgacgactctcctgtgcagcctcgtggtcttccgacgtcagtacgcagctacatcgctacgtcgggtccncgacggcgtccggagggggaacgggctgggagtcgggtctacgtagtttattactaacttcgtaggtacccactactaaccctaccgtcccgaccccgtagacggggtcctaattaaccncttccacgaaggtaacgtaccggtacgttaccggaagaaccgtacgggttattaactccttaacaaagtacgaaaccaacggtggacgacgacccggtacgaccgacgggttactttaataccgtggacgagtaagtaactacgttcggtagggttcgggttaacccggggcccttccgttaccgtttcgggtttcctaacgtccggtaatcccggttcggtccgggggaaccgttccgggg

SEQ ID NO: 409016 - DNA, 756 bp, Homo sapiens
  misc_feature: GZ8MTXP01ACJBH.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgcttatttcaaaaggtgtccagtgtgaggtgcgaggtggtggagacgtggagggaggcttgatccgagccgtggggggtccctgacgactctcctgtgcacgtcctcgtggtcttcaccgtcagtagcagctacagtcgccgacgtcgggtcccgccgacggtccgtaccgggaagggggaacgggggtcgtaggggaggttcggggttctacgttaacgttttaactttaactaaacgtttcgtacggtaacccaaactaactaaccctaccgtccccggaacccggtaggaaaccggggtcctaaacgttaaacccactaccgtaccgaagaacggtaccgtaacgttaccggaaagtaaccgtacgggttacttaacttaccttaacgaaaacgttccgggaaaacctacccgtaggaacgtaaccggacccggaacgtaaccgtaaccgggttcgttttaaacgttacgtcggttggaacggtaagttaaggttacgttacggggtaacgggttccggggttaccgggttaccttcccgtaacccgtttggtcctttaacgtcggttacgttccgttcggggttccgggg

SEQ ID NO: 409017 - DNA, 716 bp, Homo sapiens
  misc_feature: GZ8MTXP01EI7D4.3.82.H05.1.454.CMB.2.raw
  modified_base (452)..(452): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagtcgttgggttttccttgttgcttatttacaaaaggtgtccagtgtgaggtgcgaggtggtggagacgtgggaggaggcttgatccgacggccggtcggggggtccctggacgtactctccgtgtgcgacgtcctcgtcggtcttccgaccgtcagtacgcagactacatcgctacgtcgggtcccgcgaggcctaccggaaggggagggcgtgggtggtcggtctacgtagttattactacttcgtacgtaaccactactaaccctacccgtcccgtacccggtacggaaaccgggtcctaactaaccnctacctacgaggactacgacttccggaaataaccgtcggttatactacttaacaaagtacgaaacctacggtaggacgaccgtaccgaacgtacgtaccggtttacctttaaagttcgtggtaccgacggaagtaacggttacgtttcggggacgggttttacggggtaccccgggtacttaaccccggttccgttttacgggttaaccctttaacgttccggtaacgtttcccggcgggggttccgggttcccgttaaccggg

SEQ ID NO: 409018 - DNA, 701 bp, Homo sapiens
  misc_feature: GZ8MTXP01C6WZC.3.82.H05.1.454.CMB.2.raw
  modified_base (299)..(299): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcgacctcagtagcagctacgatgcacgtcgggtccnccgaggcctaccgaggggaggggctgggtagtcgggtctctaagtttattactaacttcgtaggtacccacgacttaacccgtactcccggaccccgtaggaaacggggtaccctaacgttaacccattccacccgagtaacgacgtacgttacccgaaggaaaacgtccgggttatacttaccgttaacaaaacgttagaaaccctaaacggtcggaaacggaacggtaccccgaacggtaaccgtaccgggttaccgtttttaactaaccgtggttacgccggtaagaacggttattccggggtaacgggttcgggtttacccgggggacctttacccgttccgttcggtttaacctaccgttcggtacttccgttacggtcggggttcccgttaacggg

SEQ ID NO: 409019 - DNA, 584 bp, Homo sapiens
  misc_feature: GZ8MTXP01EYQFQ.3.82.H05.1.454.CMB.2.raw
  modified_base (296)..(296): a, c, t, g, unknown or other
  modified_base (302)..(302): a, c, t, g, unknown or other
  modified_base (306)..(306): a, c, t, g, unknown or other
  modified_base (355)..(355): a, c, t, g, unknown or other
  modified_base (365)..(365): a, c, t, g, unknown or other
  modified_base (370)..(370): a, c, t, g, unknown or other
  modified_base (403)..(403): a, c, t, g, unknown or other
  modified_base (415)..(415): a, c, t, g, unknown or other
tcagagacgcactccacgaccggtgctcgatttagtcgagctctctcgcgggggcaggagtcagacccagtcaggacacagcatggacatgagggtccccgctcagctccgtggggctcctgctgctctggttcccaggttccagatgcgacatccagatcgacccagtcctccactccctccgtgtctgctatcgtggtaggggacagagtcgctatgtacgttggcgggcgtacgttcggtacggttttaacagtagttggttagtctggtatcagacaagaaaccgaggaacnccctgnttcngtatgtctgctgctactccccactagacaaggtcggactccactcagtntcgagtcctnaagtnacgtcgaggactaggtctacactctacacgtancgagacgcgtcngacacgtacgtagtacgttagttactaacttacgttatagtacgacgtacgagtacgtacgtacgtccgtccctccgtacttaccggtacggttacggggacggtaacggacggttaggacggtaacgaacgtaaaccgaacggtacggttcggtaacgttccgtaacg

SEQ ID NO: 409020 - DNA, 697 bp, Homo sapiens
  misc_feature: GZ8MTXP01A164O.3.82.H05.1.454.CMB.2.raw
  modified_base (282)..(282): a, c, t, g, unknown or other
  modified_base (297)..(297): a, c, t, g, unknown or other
  modified_base (614)..(614): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtggaggaggtcttgatccaggtccgtggggggtccctgagtactctccgtgtgcacgcctcgtggtcttcaccgtnagtagcagctaacgntggccacgtcgggtcccgcgaggcctccggaagggggaacgggggtctgggaggtcgggtacctgtaagtttactttaactaacgtttccgtaggtaccacgtacttaaaccgtacccgtcccgaacccgtagggaaacggccgtaaacttaaccgatcctaccaaggacgaacgtagttacccgaagtaaaaccgcgggttattaactacgttaacaaaattacgaaaaccaccggtaaggaacgacggacccgaaacgtccgtaccgttacggtttattaaccggtgtacgacggtagtaacgtcgttaccgggngggttccgggtacccggtacccttacccggttccgttttacggttcctacgttcgcgttccggttcggtcggggttcccgtcg

SEQ ID NO: 409021 - DNA, 687 bp, Homo sapiens
  misc_feature: GZ8MTXP01DZ629.3.82.H05.1.454.CMB.2.raw
  modified_base (265)..(265): a, c, t, g, unknown or other
  modified_base (292)..(292): a, c, t, g, unknown or other
  modified_base (324)..(324): a, c, t, g, unknown or other
  modified_base (533)..(533): a, c, t, g, unknown or other
  modified_base (590)..(590): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagtcttgggtttttccttgttgcttatttacaaaaggtgtccagtgtgaggtgcgaggtggtggagacgtgggaggaggcttgactccgaggccggtgggggtccctgacgtactctcctgtcncacgtcctcgtcggtccttcgaccgtnagtagcagactacatcgctacgtcgggtcccncgacggccgtaccggaagggggtaacgggtcgtagggtacggtcgggttacttacgttaagtttaactttaacgtaacgtttcgtacgtaaccactactaaacctaccgtcccggacccgtagggaaaccgggtacctaactaaccacttaccacgaagtacgaccgtaacgttccggaaagtaacgtacggttatacttaaccgtaanaaagtacgaaacctacggtagaacgtaccgaccgacgtaccgtcggtttactttaancgtgtacgacgtagtaacgtcgttgggtacggttcgggtaccggtacccttcgttacccgttgttaaccttagtctcgtcttcgtcggttcgtcccg

SEQ ID NO: 409022 - DNA, 806 bp, Homo sapiens
  misc_feature: GZ8MTXP01ESXBV.3.82.H05.1.454.CMB.2.raw
  modified_base (551)..(551): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgcttatttacaaaaggtgtccagtgtgaggtgcgaggtggtggagacgtggaggaggcttgatccgacgccgtgggggtccctgagtactctccgtgtgcacgcctcgtcggtcttccgaccgtcagtagcagactacatcgctacggtccggggtacccgccgaacgggtccgtaccggaagggggaacggggtcgtgggtaggttcgggtacgttacgtaagtttacttaacgtaacttcgtacggtaacctactaacttaaaccgtcccgtaaccccggtacccgggtacggtaaacccggggtacccgttaacttaaaccgacttaccgttaaccgaaggtaacggtaccggtacttaacccgggaaagtaaacccgttacgggttnttaaaccttacttaaaccgaaaagttacgtaaaaacccctcggtaggggaaaaccgtaccgggaaccccgaacggttaaaccgtacccgggtttaaccgtttttaaagccgtagggtaccggagtaaacgggtaacggttgttcccgggtaaacggggtttccggggtacccggttaccccttccgttaaccggtttccggtttctaccgttcgtaggttccccgttcggggttaacgggttcccttaaccgggg

SEQ ID NO: 409023 - DNA, 793 bp, Homo sapiens
  misc_feature: GZ8MTXP01BEJL0.3.82.H05.1.454.CMB.2.raw
  modified_base (470)..(470): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtgggaggaggcttgactccgagccgtcgggggtccctgacgactctcctgtgcagcctctggcttcaccgtcagtacgcagctacatcgcctacgtcggtcccgccgacgggcctccggaagggggaacgggggcgtggggacggttcgggttctacgtagttttaacttactaagtttcgtacgtacccaaacgtaacttaaccgtaccgtaccccggtaccccggtagggtaaaccggggtaccctaacgtttaaacccnttacccgtacgaaacgggaacgtaccggtaacgtttaaccccgggaaaggtaaacccgttacgggggttacttaaaccgttaccttaaacgtaaaacgtttacggaaaaacccgtaaaccccggttgggaaaccggtaaccggaaccccggtaaacgggtaacccgttaacccgggggtttaacctttttaagttaacccgtgggtcggtaaccggtaaaggttccgggttaaagttccgggtaaaggggtttcccgggggttaccgggttccttaccgtaacccgtttggtccttacggtcacgttccggttcggtccgggg

SEQ ID NO: 409024 - DNA, 905 bp, Homo sapiens
  misc_feature: GZ8MTXP01AZCC1.3.82.H05.1.454.CMB.2.raw
  modified_base (257)..(257): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagtcgttgggttttccttgttgcttatttacaaaaggtgtccagtgtgaggtgcgaggtggtggagacgtggaggaggcttgatccgagccgtgggggtcctgagctctctgtgcncgtcctcgtcggtccttccgaccgtcaggtacgcacgtactatagtcgaccgtaccggtccgggtccccgccgaacgggtacccgtaccgggaaggggggaacgggggtcgtagggggtaacgggtttcggggttacctttaacgtttaaacggtttaacttttaaaccgtaacgtttacccggttacggtaacccctaacgttaacccgttaaacccgttaccccgtaacccccggtaaaccccgggtagggtaaaccgggtaccccgttaaacttaaaccccgtacgttaccccgtaccggaaagaaaccggtaccggtaaccgttaccggaaaacggtaacccggtacggtttaacgttaacttaacccgttaaacaaaacgttacggaaaaccccttacggggaacggtaaaccggacccggtaaccccggtaaacggtacccggttaaccgggttttaccgttttaaacgtaccgttagggtaccggaaagggtaacggttaacgtaacgggtttccggggtaaacgggtttcccgggggttaaccccgggtaaccctttaccccggttccgggtttcgtttaacccggttaccgttaacggttcgtccccggttcgggggtcccgggttcgttaaccccggg

SEQ ID NO: 409025 - DNA, 675 bp, Homo sapiens
  misc_feature: GZ8MTXP01BJM35.3.82.H05.1.454.CMB.2.raw
  modified_base (256)..(256): a, c, t, g, unknown or other
  modified_base (258)..(258): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaggtgtccagtgtgaggtgcgaggtggtggagacgtggaggaggcttgatccgagccgtcgggggtccctgagactctcctgtncngcctctggtcttcacgtcagtagcagctacatcgcacgtcggccgccgaggcgtaccggaggggaacggggcgtgggaggtgggtctacgtagtttacttacaacttcgtacgtacccaaacacttaacgtaccctacccggacccggtaggaaccgggtcccgaaacttaacccatcctaccgaaggacgaaccgtacgttaccgaacgaaacgtacgggttataacttcgtaaacaaagtcgaaactaaacccgtggaacggaccgacccgtaacgtaaccgtaccggggtttacccgttttaatacccggttgccggtaacggtaagttagtacgttcggtaacgggttcgggttacccgggccttaccggaacccttggttaacctacgttcgacgttcgttcgggtccgggg

SEQ ID NO: 409026 - DNA, 721 bp, Homo sapiens
  misc_feature: GZ8MTXP01AVX7J.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggtagttttggctgagtcttggggtttttccttgttgcttatttacaaaaggtgtccagtgtgaggtgcgaggtggtggagacgtggaggaggcttgactccgaggccggttcggggggtccctgacgactcctccgtgtcgcacgtcctcgtcggtccttccacccggtcgagtacgccaagtcctacacgtcgacgtaccggtcgggtcccgacgacggccgtaccggaagggggacgggtcgtgggaggttcggtctacgtagtttattactaacgttcgtacgtaaccactacttaaccctacccgtcccggacccggtagggaaaccgggtacccgtaacttaacccactacctacccgaagaacggaccgtacgttaccgaacgtaacgtacggttatactaccttaacaaacgtacgaaacctaccggtaggaacgaccggacccgacgtaccgtacggttacgtttatcgtgtcgcgtaagcggtaacgttcgggtacggttcgggttaccgggtaccttaccggttccggttcggtttaacctaccgttcggtacttccggacgggttccggggccgtcccggg

SEQ ID NO: 409027 - DNA, 781 bp, Homo sapiens
  misc_feature: GZ8MTXP01DZRDE.3.82.H05.1.454.CMB.2.raw
tcagagacgcactccacgaccggtgctcgatttagtcgagctctctcgcggggggggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtggaggaggcttgatccgagccgtgggggtccctgagtctctcctgtgcacgcctcgtggcttcaccgtcagtgcagctacatgccacgtcgggtcccgcccgaggcccgtaccggaagggggaacgggggtcgtaggggaggtcggggttccttacgtaagtttatttaacgtaactttcgtacggtaacctaactacttaaaccctaccgtccccggtaccccggtagggaaacgggtacctaacttaaaccattcctaccgaagacgaccggtaattaccggaagtaaacccgtggttaagttactaccttaaactaaaactacgaaaacctaaccggtagaaaccggtaacgtaccccggaaaccggtaccgtacccgggttaccgttttaaacgttacgttggtacggaccggtaagggtaacggttaacgttccggggtaagggttttcccggggggttacccggggtaacccttttaccccgttccccgggttttacgggtttaaccgttacctttaaccggacgtttccggttccgggggtaaccggggttcccgggttaacccgg

SEQ ID NO: 409028 - DNA, 623 bp, Homo sapiens
  misc_feature: GZ8MTXP01E2LQN.3.82.H05.1.454.CMB.2.raw
  modified_base (364)..(364): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagactggaggaggcttgactccgagccgtgggggtccctgagactctcctgtgcacgcctcgtggcttcaccgtcagtagcagctacatgcacgtcgggtcccgccgaggctccggagggggaacggggcgtgggagtgggtctcgtagtttattacacttcgngtaccacactaacctacctcccgaccccgtggaacgggccattaaccatccaccagacgacgtactacccgaagaaacgtacggtagtactacttacaaatcgaaaccacccgtgaacgacgcccggaaccgaccgtaccgggtaccgttttaagtaccgtgtacggcgtaaggaacgtacgttcggtacggttcgggttcccgggaccttcccgacccgttggtttccacgtttcgctcgttcggtcgggccgtccgg

SEQ ID NO: 409029 - DNA, 609 bp, Homo sapiens
  misc_feature: GZ8MTXP01EFRO1.3.82.H05.1.454.CMB.2.raw
  modified_base (303)..(303): a, c, t, g, unknown or other
  modified_base (525)..(525): a, c, t, g, unknown or other
  modified_base (527)..(527): a, c, t, g, unknown or other
tcagagacgcactccacgaccggtgctcgatttagtcgagctctctcgcgggggctgggagaggagcccagcactgggattccgaggtgtttccattcggtgatcagcactgaacacagaggactcaccatggagttttggctgagcttgggttttccttgttgctatttacaaaaggtgtccagtgtgaggtgcaggtggtggagactggaggaggcttgatccagccgtggggggtccctgagactctcctgtgcagcctctggcttcaccgtcagtagcagctacatgcactggggtccnccaggctccgaagggggaacgggggtctgggagtgggtctcagtttactttacaattcgaggtacccaaacactaactacctcccggaacccgtggaaacgggtccaatttaaacagtctccgaagagaacgattaccgaagaaccagggtctatcttacaaattcggggaaactaaaccgtggaaagacgacccgacgaacgaacgggtctttaattacgngnggaagagagtacgttcggaggttcgggttacgggttccttctaacccgttgttaaccttacgtcgacttcgttcggtcgggg

SEQ ID NO: 409030 - DNA, 794 bp, Homo sapiens
  misc_feature: GZ8MTXP01A7C60.3.82.H05.1.454.CMB.2.raw
tcagagacgcactccacgaccggtgctcgatttagtcgagctctctcgcggggggggagaggagcccagcactgggattccgaggtgtttccattcggtgatcagcactgaacacagaggactcaccatggagttttggctgagtcttgggttttccttgttgctatttacaaaggtgtccagtgtgaggtgcgaggtggtggagacgtgggaggaggtcttgactccgacggccggttcggggggtccctaggtacggtacccttccgtccgttggtcgccgacgtcctcgtcggtccttcgaccgttcgagtagcagctacatgccgtacgtcggggtccccgcgacggccgtaccgggaagggggacgggggtcgtgggtaaggttcgggtcttacgttaaggttttactttaaacgtaccgtttacggtacggtaaccctaactacttaaacccgttacccgtcccgacccggtagggaaccggacgtaactacactcacgaagacgtacgtacgtaccgaagacgtacgtagtacttactaacaaacgtacgaaaccacggtacggaacggaccgaacccggtacgtaccggtaaccgtttacggtttaacttaccggttggaggtaccggtaaggtaacgtttaagggttccggggttaaacggggtttcccggggttacccgggggttaaccccttcggttaccccggtttcgggtttaacccgttccgttaaccgggttacgtttcccgggttcgggggtcccgggttcccggggttaaccccggg

SEQ ID NO: 409031 - DNA, 789 bp, Homo sapiens
  misc_feature: GZ8MTXP01CYHRR.3.82.H05.1.454.CMB.2.raw
tcagagacgcactccacgaccggtgctcgatttagtcgagctctctcgcggggggggagaggagcccagcactgggattccgaggtgtttccattcggtgatcagcactgaacacagaggactcaccatggtagttttggctgagtcttgggttttccttgttgcttatttacaaaaggtgtccagtgtgaggtgcagggtggtggagacgtgggaggaggtcttagactccgacggtcccggttcgggggggtccctggacgtacctccgtccgtgtgccgacgtccctcgtacggtccttaccgtacccgtagagtacgacagactaacatcgaccgtacggtcgggtccccgccgtacgggtccgtaccggaaggggggaaggggtcgtagggtagggtcgggttacctagttaagtttactttaacgttaactttccggtacggtacctaactacttaaacctacccgttccccggaccccgtagggtaaaccgggtacctaacttaaccactacccgtacgagaaccgtacgtacgttacccggaaagtaacggttcggttaacttacgtaaccctaagtaaaacgtacgaaaccctaacggtagggaaaccgaccgaacccggaacgtacccgacggtttacttttaacgacgtggcgtacggaaggtaataccggtttagggtcgggttacgggttcccggggtaacccttccgttacggttttcgttaaccttacgttccgtacgttccgttccgggggttaacgggttcccggtaaccgg

SEQ ID NO: 409032 - DNA, 687 bp, Homo sapiens
  misc_feature: GZ8MTXP01CAFGI.3.82.H05.1.454.CMB.2.raw
  modified_base (446)..(446): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgcttatttcaaaaggtgtccagtgtgaggtgcaggtggtggagacgtgggaggaggcttgatccgagccgtgggggtccctgagactctctgtgcagcctctcggtcttcaccgtcagtacgcagctacatgccacgtcgggtccgccgacggccgtaccggagggggaacggggcgtgggtaggttcggtcttaccgtagtttaccttacgtaagttccgtacgtaccaactacgtaacctaccgtacccggacccgtaggaacgggtaccgtaactaacccnctactccgaagacgacgtacttaccgaagtaacgtacggtattacgtacttacgaaacgtacggtaaacgtaaccgtggaacgtacgacccgaacgaccgttaccgggttccgtttaagttaccgtggtaccgaaggtaagagttacgttacggtaacgggttcgggttaccggggttccttaccgtaacccggtttcggttaaccttacggttccgttacgtccggttcgggtcccgggg

SEQ ID NO: 409033 - DNA, 818 bp, Homo sapiens
  misc_feature: GZ8MTXP01E42ZE.3.82.H05.1.454.CMB.2.raw
  modified_base (253)..(253): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccagccgtgggggtcctgagactctctgtgcancctctggcttcaccgtcagtagcagctacatcgactacgtcggtcccgccgaacggggccgtacccgggaagggggaaacgggggccgttaggggtacggttcgggggttaccttacgtaaggtttaactttacgaaactttccgttacggtaaccctacgacttaaaccgtaacccgtccccggaacccccggtaggaaaccggggtacccgtaatttaaaccccgacttaccctaccgtaaacgaacggtaacgaacgttacccgggaaacgtaaacccgtacgggtttaacgttaacttaacctttacgaaaacgttaccgaaaaccgttaaaccccgggttagggaaacggtaacccggacccgaacccggtaacccgtaccgggttaacccgttttaacttaacgtcgtaacggacggtaaagtaacgttaaacggttcgggtaacgggtttccggggttaacccgggggacccctttaccggttaccccgttcgttttaaccctaccgtttccgaacttccgggttaccgtttccggggggaaccccgtttaaccgggg

SEQ ID NO: 409034 - DNA, 746 bp, Homo sapiens
  misc_feature: GZ8MTXP01BY7CF.3.82.H05.1.454.CMB.2.raw
  modified_base (620)..(620): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttacaaaaggtgtccagtgtgaggtgcaggtggtggagacgtggaggaggcttgatccagccgtgggggtccctgagactctcctgtgcacgtcctcgtggcttcaccgtcagtagcagctacatcgctacgtcgggtcccgccgaggccgtaccggagggggaagggggtcgtgggaggttgggtctcgtagtttatttactaacttcgtaggtaaccactactaaccctacctccccggaccccgtagggaaacgggccgtaacttaaccgacttcctaccgaagacggacgtaacgttccggaaagtaaccgtagggttctaactccgttaaacgaaaacttacgaaaccctaaccggtagaaacggtaccggaacccgtaacggacccgtaaccgggttacctttttaaagtcgttagggtacgacggtaagtaacgttacgtttaccgggnggtttccggggttaaccccggggaaccctttacccggttcccgggtttcgggtttaaaccctttaccgtttaaccgggtaactttccgggtttcccggggttccgggggttcccgtttaaccgggg

SEQ ID NO: 409035 - DNA, 823 bp, Homo sapiens
  misc_feature: GZ8MTXP01CBUIU.3.82.H05.1.454.CMB.2.raw
  modified_base (524)..(524): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggtagttttggctgagtcgttgggttttccttgttgcttatttacaaaaggtgtccagtgtgaggtgcgagggtggtggagacgtggaggaggcttgactccgaggtccggtcgggggtccctgacgtacttcctccgtgtcgcacgtcctcgtcggtccttcgaccgtgacgtagacacgtctacatcgccgtacggttcggggtcccgccgacggtaccgtaccgggagggggtaacggggtcgtagggggtacggttcgggttcttacggttaagttttaaccgtttaactaacgtttccgtacggtaaccctaaaccttaaccgttaacccggttacccgtaccccgggtacccgggtagggaaaccgggtacccgtaaacttaaacccnttacccgtaaccgaaggtaacgaccgttaacgttacccgaagtaacgtacgggttactacttaaccgttaagaaacgttaccggaaaactacccggggtgaaaccggtaaccgaccccggtaaaccgtaccggtttaaccccgggttacttttaaagtaccggtcgggttaacgaaccgggtaaggtttacgggtaaccgtttcgggtaacggtttcccgggggttaccccggcctttacccgtaacccggtttcggttaacttccggtacgttacgttccccggttcgggtcccgggg

SEQ ID NO: 409036 - DNA, 846 bp, Homo sapiens
  misc_feature: GZ8MTXP01BUTK0.3.82.H05.1.454.CMB.2.raw
  modified_base (263)..(263): a, c, t, g, unknown or other
  modified_base (298)..(298): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagactgggaggaggcttgactccaggccggtggggggtccctgacgtactctcctgtcgcncgtcctgtcggcttcaccgtcagtacgcagcctanagtcgccacggttcggggtccccacgacggtcctaccgggagggggaacgggggtcctggggacggttggggtaccttacgtaagtttttaacctttaccgtaaagttttcccgtacgggttaacccctaaacgtaaccttaacccgttaaacccgtccccccgggtaaaccccgggtttaaggggaaacccggggtaccccgttaaatttaaaacccccgcgttttacccgtacccccggaaaagggtaacccgggtaaccgttaaaccgtttaaaccccggggaaacggttaaaccggttacgggggtttaaacgttacctttaaccctttaaaaccgtaaaacgttaccgggggaaaaaaccctaaccccggttagggaaacgtaacccgggaccccgtaaagggtaccccgtaacccggggtttcttttaaacggtaccgttggtccgtaaccggaaggttagtacgttcggtacgggttacgggttacccgggttcttcccgtccgttaggttcctccggtattccgttcgttccgggtcggg

SEQ ID NO: 409037 - DNA, 737 bp, Homo sapiens
  misc_feature: GZ8MTXP01ADRTC.3.82.H05.1.454.CMB.2.raw
  modified_base (282)..(282): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgcttatttcaaaaggtgtccagtgtgaggtgcaggtggtggagacgtggaggaggcttgatccgaggccgtggggggtccctgagtacctctcctgtgcagtcctcgtggcttcaccgtnagtagctagctacatcgctacgtcggtcccgaccgaggccgtaccggaggggaacggggtcgtacggggtaggttcgggtcttacgtagttttaacctttaaccgaattttccgtacggtaaccctaacgttaactaacccgtaaaccgtacccccggtacccccgggttaagggaaaccgggtaccccgtaaactttaaacccacgtttaccgtacccgtaaggacggtaaaccgtacgtttaacccggaaggtaaacctacggttacgtacttacttaaaccgaaagtacgaaacaaccgtcgaaacggacgccccgaacggacccgttacgggtccttttaacgtacgtacgtcggaacggaggttagtaccgttggtaacgggttcgggttccgggttcccttcgtaaccccgttggttccttacgtccgttacgtcgttccggtccgggg

SEQ ID NO: 409038 - DNA, 575 bp, Homo sapiens
  misc_feature: GZ8MTXP01AY7X2.3.82.H05.1.454.CMB.2.raw
  modified_base (424)..(424): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatcagcctgggggtccctgagactctcctgtgcagcctctggcttcaccgtcagtagcagctacatgcacgtggtccgccaggctccgaggggaagggctgggagtgggtctctagttaattacgaattcgtacggactaaacgataactactacccgacccgtagaacgggccaaattaaccatcacagagacattaccggaanaagcgtagactataacaaataggaaacacgtgaacgacgaccaacgaccgtaacggtacctttaatacgtgtgaagtaagagtacttcggtaggtcgggttacggcccttacgaacccgttggtaacctacgtcgacttcgttcggtcggg

SEQ ID NO: 409039 - DNA, 654 bp, Homo sapiens
  misc_feature: GZ8MTXP01BHC22.3.82.H05.1.454.CMB.2.raw
  modified_base (277)..(277): a, c, t, g, unknown or other
  modified_base (312)..(312): a, c, t, g, unknown or other
tcagagacgcactccacgaccggtgctcgatttagtcgagctctctcgcgggggcaggagtcagacccagtcaggacacagcctggacatgagggtccccgctcagctccgtggggcctcctgctgctctggttcccaggttccagatgcgacatccagatcgacccagtcctccatcctccgtgtctgctatcgtggtaggggacaggagtcgtctatgtacgttggtcgggctaacgtcgttacggttttaacagtagttgggttatcgtggtancagacaagaaaccgaggaaactccctggacgttcngattgtctgctgcacctccacccgtagactaaaggtcgacgtccctagtccccaggtacttacgacgggtacctacgaagttcgacgttcggagggacctagtacgttcaaccttctacgacctagacgacgtacacgtcctcgacacgtacgtattagtaacttttcgggaaactttaacgttaacttagtacgtaaccgaagtccggtcctaactcgtacttccccgcccgttaagttacccgttacgggttccggggaacgggaaacgggttaccaaaagggggttcaacgttaacgaaaccgaaacggtttaactcgggttcggaacgttcgaacccc

SEQ ID NO: 409040 - DNA, 760 bp, Homo sapiens
  misc_feature: GZ8MTXP01A6N3Z.3.82.H05.1.454.CMB.2.raw
  modified_base (275)..(275): a, c, t, g, unknown or other
  modified_base (287)..(287): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgactccgagccgtgggggtccctgagtactctcctgtgcagcctcgtggcttcaccgtnagtgcagcgtanagtcgacgtacgttcgggccgacccgagggcctaccggaagggggtaacggggccgtagggacggttcgggtacctcgtaggtttaaactttacaacgtttctacggtacctaacgacctaaaccgtacccgtcccggaaccccggtagaaacccggggtactaaccgtttaaaccactaccgtcccaagtaaccggtactaaccggtttaccgaagtaaacccgttaggggtaattaccgttacctaagtaacgacgaaaccaacgggtcgtaaacggaccgaacccgtaccgaaaccggttccggtaccgttttaagtacccgtagggttacggacccggtaagtaacggtaccgtttaggggacggtttaccgggggttacccgggtaaacccttcgttaaacccccggtttggttaacccttacgtttccgacggttcccgttacgggttcgggttaacccgttcccgg

SEQ ID NO: 409041 - DNA, 638 bp, Homo sapiens
  misc_feature: GZ8MTXP01DJPBJ.3.82.H05.1.454.CMB.2.raw
  modified_base (261)..(261): a, c, t, g, unknown or other
  modified_base (301)..(301): a, c, t, g, unknown or other
  modified_base (325)..(325): a, c, t, g, unknown or other
  modified_base (371)..(371): a, c, t, g, unknown or other
tcagagacgcactccacgaccggtgctcgatttagtcgagctctctcgcggggggggagaggagcccagcactgggattcagaggtgtttccattcggtgatcagcactgaacacagaggactcaccatggagttttggctgagctgggttttccttgttgctatttcaaaaggtgtccagtgtgaggtgcaggtggtggagacgtggaggaggctttgatccgagccgtgggggtccctgagactctcctgtgcagcctntcggcttcacgtcagtagcagctacatgcacgtgggtccnccaggctacgaggggagggctggngtggtctcgagtttattaccaattctgtacccactaattacctccncccgtacccccgtagaacggggcctaagttaaccatcctcgagacgactagttcccgaagaacgtacggttgtaacttcttaacaaattcgaaacgtaacccgtggaaacgacgacccggaaccgtacgtaccgggttaccgttttataaccgttggtcgacgaaggtacgagtttacggaggttcgggttacccggggccctttccgaccccgttttgggtacctttaaccgttcgacgttccgttccggttcgggggtaaccccg

SEQ ID NO: 409042 - DNA, 499 bp, Homo sapiens
  misc_feature: GZ8MTXP02F576D.3.82.H05.1.454.CMB.2.raw
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagtatggttagtctggtatcagcagaaaccagggaaacgcccctgagttcctgatgtctgctgcatcccacctgacaaagtggagtccatccagattcagctcagtgaatcgtgggacagagttcactctcaccatcagcagcctgcagcctagaagtatttgactaacttactattacgtacaacaggctagaactgtcctcccgactctacgtttcggacggacggaccaaggtgaagatacgaaacgactgaggctag

SEQ ID NO: 409043 - DNA, 584 bp, Homo sapiens
  misc_feature: GZ8MTXP02GHUUX.3.82.H05.1.454.CMB.2.raw
  modified_base (257)..(257): a, c, t, g, unknown or other
tcagagacgcactccacgaccggtgctcgatttagtcgagctctctcgcggggagaggagcccagcactgggattccgaggtgtttccattcggtgatcagcactgaacacagaggactcaccatggagttttggctgagcgtggtttcgtgtaggctattcaaaggtgtcagtgtgaggtgcaggtggtggagactggaggaggcttgatccagcctgggggtccctgagactctcctgtgcagctctggcttccncgtcagtagcagctacatgcacgtcggtccgccgacggcgtccggacggggaggggcggtgggtaggtgggtcgtcgtagttatttactaacttacgtacgtactactactactacctccgtacccgtacgacggaccgtactaactactactaccacgacgacgtacgtacgacgaacgacgtagtatacttactaatagaacaactagagacgacgacgacgacgtacgttacttacgtgtgacgagtacgtagtagtacggtcggtcgggtaccgtaccgtaccgtcgttcgttacgttacgtacgtcgtcgtcggtcggtcgg

SEQ ID NO: 409044 - DNA, 528 bp, Homo sapiens
  misc_feature: GZ8MTXP02IGL7R.3.82.H05.1.454.CMB.2.raw
tcagagacgcactccacgaccggtgctcgatttagtcgagctctctcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctgggagtggggtctcagttatttacaattctggtacacatactactccgaccctgaagggccgattaaccatctccagagacgattccgagaacacggtgatcttcaaatgaaacaaacctgagagccgacgacacggccgtttatactgtgcgagagattcgagtggtcgggtacctcgaccctggttctacttcgactctcgtgggccgtgg

SEQ ID NO: 409045 - DNA, 497 bp, Homo sapiens
  misc_feature: GZ8MTXP02I384Q.3.82.H05.1.454.CMB.2.raw
  modified_base (340)..(340): a, c, t, g, unknown or other
  modified_base (396)..(396): a, c, t, g, unknown or other
  modified_base (422)..(422): a, c, t, g, unknown or other
tcagagacgcactccacgaccggtgctcgatttagtcgagctctctcgcggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaacgcccctgacgttcctgatgtctgctgcatccacctgcaaagtgagtcccatccagattcagcgtcngtgaatcgtgggacagagttcactctcacatcagcacgcctgcagcctagaacgtntttcgactaacttatattgtacaacnggctgacacgtctcccgctctacgttcggacggtacggaccgaggtcggaagactacgaaacgactggtcgctcg

SEQ ID NO: 409046 - DNA, 539 bp, Homo sapiens
  misc_feature: GZ8MTXP02JX1JZ.3.82.H05.1.454.CMB.2.raw
  modified_base (293)..(293): a, c, t, g, unknown or other
  modified_base (353)..(353): a, c, t, g, unknown or other
tcagagacgcactccacgaccggtgctcgatttagtcgagctctctcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccnccaggctccgaggggaaggggctgggagtgggtctcagttatttacaattctggtaccanatactactccgacccgtgaacgggccgattaaccatctccagagacgattccgagaacacggtgtatcttacaaatcgaacaacctgagagccgaacgacacggtccgtttatactgtgacgagacgattcgagtgggttcgggacctcgaccctggtctacttcgactcgtcgtcggggcctcgg

SEQ ID NO: 409047 - DNA, 545 bp, Homo sapiens
  misc_feature: GZ8MTXP02G371P.3.82.H05.1.454.CMB.2.raw
  modified_base (354)..(354): a, c, t, g, unknown or other
  modified_base (391)..(391): a, c, t, g, unknown or other
  modified_base (411)..(411): a, c, t, g, unknown or other
  modified_base (416)..(416): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggtttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactgggtccgccaggcctccgaggggaaggggctgggagtgggtctcagttattacaattctggtaccanatactactcccgacccgtgaacggccattaaccatcnccagagacgatccgagaacncggtntatctacaaatgaaacaactgaagacgccgaacgacacgggtacctttatactgtagacgagacgattcgagtgggttaccgggacctcgacccgttggtctacgttcgatccgtcgtcggggcctcgg

SEQ ID NO: 409048 - DNA, 693 bp, Homo sapiens
  misc_feature: GZ8MTXP02GPGT2.3.82.H05.1.454.CMB.2.raw
  modified_base (298)..(298): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcgtggtttcgtgttaggctattcaaaaggtgtccagtgtgaggtgcaggtggtggagactggaggaggcttgatccagccgtgggggtccctgagctctcctgtgcagcctctggcttcaccgtcagtagcagctacatgcactggggtcccncgagcgtacggaggggagggcgtggaggtggtctacgtagtttaacttactaactttcgtacgtaaccactaactaccgtacccgtacccggtaaccccggtagggaaccgggtacctaaacttaaacccgacttaccgtacccgaagaacgtaacgtaacgttaccgaacgaaacgtacggttagttacttaccttaaacgaaaagtacgaaacctaaccgtaggaacggaccgaacccgaacggaaccgtaccggttaccgtttaacgttacgtggtacggacggtaagtacgttacggttacggtagggtttaccggggttaccggggtacccttacccggtaacccgtttcggtttaccttaccgttacggtacttccggttcggtcgggg

SEQ ID NO: 409049 - DNA, 579 bp, Homo sapiens
  misc_feature: GZ8MTXP02JTAVH.3.82.H05.1.454.CMB.2.raw
  modified_base (261)..(261): a, c, t, g, unknown or other
tcagagacgcactccacgaccggtgctcgatttagtcgagctctctcgcgggggagaggagcccagcactgggattccgaggtgtttccattcggtgatcagcactgaacacagaggactcaccatggagttttggctgagcggtggtttcgtgtaggcgtattacaaaaggtgtcagtgtgaggtgcaggtggtggagactggaggaggcttgatccagccgtgggggtcctgagctctcctgtgcagctctggcttccncgtcagtagcagcacatgcacgtcggtccgcgacgcgacgagggagggcggtggtggtggtcgtcgtagttattactacttcgtacgtacactactactacgtccgaccgtacggacggacgtactaactactctacacgacgacgtacgtacgaacgaacgtacgtagtactactactaactacgaacgaacgtacgagacgaccgacgacgacgtacgttacgttacgtagtacgacgagacgtagtacggtacggtcggtacggtaccgtaccgtaccgtcgttcgttacgtacgtacgtcgtcgtcggtcgtcg

SEQ ID NO: 409050 - DNA, 544 bp, Homo sapiens
  misc_feature: GZ8MTXP02JDV5G.3.82.H05.1.454.CMB.2.raw
  modified_base (413)..(413): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccgccaggctccgaggggaaggggctgggagtgggtctcagttatttacaattctggtaccacatactactccgacccgtgaacgggccgattaaccatctccagagacgattccgagaacncggtgtatcttacaaatgaaacaacctgagacgccgacgacacggtctttatactgtgcgagagattcggagtgggttcggggacctcgacccgttggttctacttcggacttcgtcgtgggggccgtcgg

SEQ ID NO: 409051 - DNA, 561 bp, Homo sapiens
  misc_feature: GZ8MTXP02HW4AN.3.82.H05.1.454.CMB.2.raw
  modified_base (255)..(255): a, c, t, g, unknown or other
  modified_base (353)..(353): a, c, t, g, unknown or other
  modified_base (410)..(410): a, c, t, g, unknown or other
  modified_base (415)..(415): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctntggcttcaccgtcagtagcagctacatgcacgtgggtccgcaggctccgaggggaaggggctgggagtgggtctctagttattacaattctgtaccanatactactccgacccgtgaacggccgattaaccatctccagagacataccgagaacncggtntatcttacaaatgaaacactgagacgccgacgacgacgtcgtttaatacttgtagcgagagtactttcgaagttcgggttaccggggaccttcgacccgttggttccttaacgttcggaacttccgtcgttcgggggtccgttcgg

SEQ ID NO: 409052 - DNA, 605 bp, Homo sapiens
  misc_feature: GZ8MTXP02H7ZPM.3.82.H05.1.454.CMB.2.raw
  modified_base (417)..(417): a, c, t, g, unknown or other
  modified_base (449)..(449): a, c, t, g, unknown or other
tcagagacgcactccacgaccggtgctcgatttagtcgagctctctcgcgggctgggagaggagcccagcactgggattccgaggtgtttccattcggtgatcagcactgaacacagaggactcaccatggagttttggctgagcgtgggttttccttgttgctatttacaaaaggtgtccagtgtgaggtgcaggtggtggagactgggaggaggcttgatccagccgtggggggtccctgagactctcctgtgcagcctctggcttcaccgtcagtagcagctacatgcacgtgggtccgccgaggctccggaggggaaggggctgggagtgggtctcgagtttacttactaattctaggtaccactaactacctacctcccgaccccgtagaacgggccgaaattaacccatcnccaagacgacgattaccgaagaacgtacggtntatctacaaatcgaaactaacctgagacgaccgaacgacgtacggtcctttaatacgtgtacgacgaaagtagtacttacggaggttcggggtaccgggtacctaccgtaaccccgttggttacccttacgttcgtacgttcgttcggtccggggg

SEQ ID NO: 409053 - DNA, 503 bp, Homo sapiens
  misc_feature: GZ8MTXP02J3009.3.82.H05.1.454.CMB.2.raw
  modified_base (354)..(354): a, c, t, g, unknown or other
  modified_base (367)..(367): a, c, t, g, unknown or other
  modified_base (390)..(390): a, c, t, g, unknown or other
  modified_base (435)..(435): a, c, t, g, unknown or other
  modified_base (470)..(470): a, c, t, g, unknown or other
tcagagacgcactccacgaccggtgctcgatttagtcgagctctctcgcgggggagaggagcccagcactgggattccgaggtgtttccattcggtgatcagcactgaacacagaggactcaccatggagttttggctgagctgggttttcctgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccgccaggctccaggggaaggggctgggagtgggtggcagtatgtcacatgatggaagaaaaatntacgcagactccngaagggtcgattcacatctccanagacaattcaaacacaccctgtatttgcaaatgaacagccctganaactgaagacaacggctatctatactgtgcgaganaatcagtccgacgaacgaaatcgacttaacggg

SEQ ID NO: 409054 - DNA, 508 bp, Homo sapiens
  misc_feature: GZ8MTXP02HK9AI.3.82.H05.1.454.CMB.2.raw
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgtcggttttaacagtatggttagtctggtatcagcagaaaccaggaaacgcccctgagttcctgatgtctgctgcatcccacctgacaaagtgacgtccatccagattcagcgtcagtgaatcgtagggacagagttcactctcaccatcagcagcctgcagcctagaagtattttgactaacttactattgtacaacaggctagactacgtcctcccgcttcgtacgtttcgggacggacgggaccaagggtgaagatacgaaaacgactcggtgactcg

SEQ ID NO: 409055 - DNA, 534 bp, Homo sapiens
  misc_feature: GZ8MTXP02IYBS8.3.82.H05.1.454.CMB.2.raw
  modified_base (353)..(353): a, c, t, g, unknown or other
  modified_base (415)..(415): a, c, t, g, unknown or other
tcagagacgcactccacgaccggtgctcgatttagtcgagctctctcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccgccaggcctccgaggggaaggggctgggagtgggtctcagttattacaattctggtaccanatactactccgacccgtgaacggccattaaccatctccagagacgattccgaagacacggtntatcttacaaatgaaacaacctgagagaccgacgacacggtacgttatactgtgcgagagattcggagtggttcggggacctcgaccctggtcctacgttcgatctcgtggggcctcgg

SEQ ID NO: 409056 - DNA, 566 bp, Homo sapiens
  misc_feature: GZ8MTXP02GO6XR.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccgccaggctccgaggggaaggggctgggagtgggtctcagttatttacaattctaggtaccacatacctactcccgacccgtgaacggccattaaccatctcagagacgattccgaagaacacggtgtatcttacaaatgaaacaacctagagacgaccgaacgacgacggtccgtttaatacctgtgacgagagtagttcgaggttcgggttacggggacctcgaccccgttggttcctaacgtttcgacttccgtcgtcgggggtccgtcgg

SEQ ID NO: 409057 - DNA, 553 bp, Homo sapiens
  misc_feature: GZ8MTXP02FXQ5S.3.82.H05.1.454.CMB.2.raw
  modified_base (369)..(369): a, c, t, g, unknown or other
  modified_base (430)..(430): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccgccaggctccgaggggaaggggctgggagtggggtctcgagttactttacaattcgtggtaccacatactacnccgacccgtgacggccgataaccatctaccagagacgatcgagaacacggtgtactcttanaaatgaacacctgagagaccgacgacacgggtcctttatacgtgtacgcgagagtacttcggagttcgggttacggggaccttcgaacccgttggtaccttacgttcgatccgtcgtccgggg

SEQ ID NO: 409058 - DNA, 547 bp, Homo sapiens
  misc_feature: GZ8MTXP02GV1RC.3.82.H05.1.454.CMB.2.raw
  modified_base (330)..(330): a, c, t, g, unknown or other
  modified_base (344)..(344): a, c, t, g, unknown or other
  modified_base (359)..(359): a, c, t, g, unknown or other
  modified_base (412)..(412): a, c, t, g, unknown or other
  modified_base (417)..(417): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcgtggtttcgtgtaggctattacaaaggtgtccagtgtgaggtgcaggtggtggagactggaggaggcttgatccagccgtggggggtccctgagactctcctgtgcagcctctggcttcaccgtcagtagcagctacatgcactgggccgccaggctccgaggggaggggctggagtgggtctnagttattacattcngtaccacatcctacnccgacccgtgaacgggccattaacccattccaccagagacattccgagaaacncggtntatcttacaaatgaacaaccagagagacgacgacgacgaccgttattactgtggacgagagtacgtacgtacggtcggtcggtaccgtccgtaaccgtcgttacgttacgttacgtacgtcgtcgtcggg

SEQ ID NO: 409059 - DNA, 513 bp, Homo sapiens
  misc_feature: GZ8MTXP02H9DTI.3.82.H05.1.454.CMB.2.raw
  modified_base (276)..(276): a, c, t, g, unknown or other
  modified_base (341)..(341): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctcgtgtctgcatctgtaggggacagagtcgctatgactttgtcgggcgactcgtcggttttaacagatggttagtctggtatcagcagaaaccagggaaancccctgagttcctgatgtctgctgcatcccacctgacaaagtgacgtccatccagatcagcgtcngtgaatcgtagggacaggattcactctcaccatcagcagctgcagcctagagtattttgactaacttactatttgtacaacgagctagactacgtcctcccgacttccacgtttcggacggtacgggaccgaaggtggaagactacgaaaacgacgttcggacggtactacg

SEQ ID NO: 409060 - DNA, 611 bp, Homo sapiens
  misc_feature: GZ8MTXP02HI6D8.3.82.H05.1.454.CMB.2.raw
  modified_base (250)..(250): a, c, t, g, unknown or other
  modified_base (262)..(262): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcgtggtttcgtgtaggctattacaaaaggtgtcagtgtgaggtgcaggtggtggagactgggaggaggcttgatcagccgtgggggtcccgtgagactctcctgtgcncgctctgtctcncgcagtagcagctacatcgcacgtcggtccgcgacggcgcggagggagggcgtggaggtggtcgtctagttattactaactacgtacgtacactactactactccgtacccgtacggaacggaccgtaactaacactactacacgacgacgtacgtacgaacgaacgtacgtagtactacttactaaactaacgaaactaaacgtacgacgacggaccggaaccgaaccgacggtacgttacgttacgtagtacgacgagacgtacgtacggtacggtacgggttacgggtaccgtaccgtaccgttcgttaacgttacgttacgtacgtcgtcggtcgggtccggtcg

SEQ ID NO: 409061 - DNA, 490 bp, Homo sapiens
  misc_feature: GZ8MTXP02J1Z4I.3.82.H05.1.454.CMB.2.raw
  modified_base (417)..(417): a, c, t, g, unknown or other
  modified_base (434)..(434): a, c, t, g, unknown or other
tcagagacgcactccacgaccggtgctcgatttagtcgagctctctcgcggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagctcagtgatcgtgggacagagttcactctcaccatcagcagcctgcagcctagaacgtattttgactaacttactattgtacaacnggctgacagtctcccgntcacttcggcggaggaccgaggtcgagagtaacgaaacgacgtgtaggctcgcacc

SEQ ID NO: 409062 - DNA, 602 bp, Homo sapiens
  misc_feature: GZ8MTXP02H5U8L.3.82.H05.1.454.CMB.2.raw
  modified_base (257)..(257): a, c, t, g, unknown or other
  modified_base (462)..(462): a, c, t, g, unknown or other
  modified_base (466)..(466): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctcnggcttcaccgtcagtagcagctacatgccactcggggtcccgccaggcctaccgaaggggaaggggctgggaggtggggtctcgtaagttattacaacttctaggtaccactatactacctcccgaaccccgtgaaacgggcccgtaattaacccatccctaccgaagacgacgtactacgaagaacgtacggtatactacttanaaanacgaactaacgtgaagacgaccgacgacgaccggtacgttactcgtagtgacgaagagtagtcggacgttcggggtccggtacctccgtaccgttggttcctacgttacgcgttccgtcggtccggggtcgtccgg

SEQ ID NO: 409063 - DNA, 548 bp, Homo sapiens
  misc_feature: GZ8MTXP02IZK9N.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccaggggaaggggctgggagtgggtctcagttatttacaattctggtaccacatactactccgacccgtgaaacggggccgattaaccatctccagagacgaattccgaagaacacggtgtaatcttacaaatagaaacaaacctagagacgaccgacgacgacggtaccgtttatactgtgcgagagattcgaggtggttcggggacctcgacctggtctacttcgactctcgtcggggcgtcgg

SEQ ID NO: 409064 - DNA, 629 bp, Homo sapiens
  misc_feature: GZ8MTXP02H42TC.3.82.H05.1.454.CMB.2.raw
  modified_base (252)..(252): a, c, t, g, unknown or other
  modified_base (275)..(275): a, c, t, g, unknown or other
  modified_base (539)..(539): a, c, t, g, unknown or other
  modified_base (545)..(545): a, c, t, g, unknown or other
  modified_base (607)..(607): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctattttcaaaaggtgtccagtgtgaggtgcaggtggtggagactggaggaggcttgatccagccgtgggggtccctgagactctcctgtgcngcctctggcttcaccgtcagtancagctacatgcacgtcgggtccgccgaggcctaccggaggggaaggggcgtagggaggttgggtctcgtaagtttactttacaacttcgtacggtacccatacttacgtacccttcccggaacccccgttaggaacggggccctaattaacccattaccacccgagacgaccgtacttaccggaagtaaacgtacgggttataactacttacaaaatacggaaacctaacgtgaacgacgaccgtacgacgacggtcctttaancgttgngacgagtagtagttcggacggtcggtacccgggactccgtaccgttggtaacctacgttacncgtccttcggcggggtcctcgg

SEQ ID NO: 409065 - DNA, 548 bp, Homo sapiens
  misc_feature: GZ8MTXP02GSQL9.3.82.H05.1.454.CMB.2.raw
tcagagacgcactccacgaccggtgctcgatttagtcgagctctctcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccgaggggaaggggctgggagtgggtctcagttatttacaattctggtaccactatactactccgacccgtgaacgggccgattaaccatctaccagacgacgattcccgagaacacggtgtatcttacaaatgaaacaaacctgaagacgccgacgacgacggtaccgtttatactgtagcgagagatcgagtggttcgggacctcgacccgtggttctacgttcgactctcgtcggggccgtcgg

SEQ ID NO: 409066 - DNA, 549 bp, Homo sapiens
  misc_feature: GZ8MTXP02FLO54.3.82.H05.1.454.CMB.2.raw
  modified_base (416)..(416): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcgtggtttcgtgtagctattcaaaaggtgtcagtgtgaggtgcaggtggtggagactggaggaggcttgatccagcctggggggtccctgagactctcctgtgcagcctctggcttcaccgtcagtagcagctacatgcactgggtccgccaggctccgaggggaaggggctgggagtgggtctcagttatttacaattctggtacacatactactccgacccgtgaacgggccattaaccatctccagagacgattccgagacacggttntatctacaatagaacacgtgagacgaccgacgacgacggtacttatacgtgtagacgagagtacgtacgtacggtacggtacgggtaccgtaccgtaaccgtcgttacgttacgttacgtacgtcgtcgtcgg

SEQ ID NO: 409067 - DNA, 533 bp, Homo sapiens
  misc_feature: GZ8MTXP02JBJDT.3.82.H05.1.454.CMB.2.raw
  modified_base (293)..(293): a, c, t, g, unknown or other
tcagagacgcactccacgaccggtgctcgatttagtcgagctctctcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccncaggctccgagggaaggggctgggagtgggtctcagttatttacaattctggtacacatactactccgacccgtgaacgggccattaaccatctccagagacgattccgagaacacggtgtatcttacaaatgaaacaactgagacgccgacgacacggaccgtttatactgtagcgagacgattcgaggtggttcggggacctcaccgtggttctacttcgatctcgtcggggcctcgg

SEQ ID NO: 409068 - DNA, 569 bp, Homo sapiens
  misc_feature: GZ8MTXP02GRAF1.3.82.H05.1.454.CMB.2.raw
  modified_base (421)..(421): a, c, t, g, unknown or other
  modified_base (426)..(426): a, c, t, g, unknown or other
  modified_base (433)..(433): a, c, t, g, unknown or other
  modified_base (481)..(481): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccgaggctaccgaggggaacggggctgggagtgggtctcgagtttattacaattctgtaccacatacctactcccgacccgtgaacgggccaattaaccatcctccagagacgatccgaagaacncggtntatctanaaatgaaacaactgaagacgaccgaagaccacgggtacctttatacgngtacgacgagacgtattcggaggttcgggttccgggacctccgtacccgtggttaactacgttcgacttcctcggtcggggccgtcgg

SEQ ID NO: 409069 - DNA, 503 bp, Homo sapiens
  misc_feature: GZ8MTXP02JC4EP.3.82.H05.1.454.CMB.2.raw
  modified_base (239)..(239): a, c, t, g, unknown or other
  modified_base (449)..(449): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgtgacatccagatgacccagtctccatcctccgtgtctgcatctgtaggggacagagtcgctatgacttgtcgggcgactcgcggttttaacngatggttagtctggtatcagcagaaaccagggaaacgcccctgacgtttcctgatgtctgctgcatcccacctgacaaagtggagtcccatccagattcagctcagtgaaatcgtgggacagagttcactctcacatcaagcagctgcagcctagaagtattttcgactaacttactaattcgtacaacgaggctgactagtcctcccgntcactttcgggcggacggaccgaggtgaagactacgaaacgactgtacggctcg

SEQ ID NO: 409070 - DNA, 649 bp, Homo sapiens
  misc_feature: GZ8MTXP02IWKP6.3.82.H05.1.454.CMB.2.raw
  modified_base (438)..(438): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccgccgaggctccgaggggaaggggctgggagtgggtctctagttattacaattctcgtaccatactacctacctcccgacccgtagaacgggccgtaacttaaccatccctaccagagacgattaccgaagaaacacgggttntacttaccttacaaaattagaaaacctaaaccgtggaacgacgacccggaacgaaccgaccggttaccgtttaattaccgtggtacgcgaagtaaggtactttccgggaaggttcggggttaccgggggtaccctaccgtaacccccggtttggtttaacccttaacgtttccggtaacttccgttacggtccggggggtccctttccggg

SEQ ID NO: 409071 - DNA, 554 bp, Homo sapiens
  misc_feature: GZ8MTXP02IIZUC.3.82.H05.1.454.CMB.2.raw
  modified_base (396)..(396): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcacgtgggtccgccaggctccgaggggaaggggctgggagtgggtctcagttattacaattctggtaccacatactactccgacccgtgaacgggccattaacatctccaganacgatccgagaacacggtgtatcttacaatagaaacaacctgagagccgacgaccgacggtcgtttatactgtgcgagagattcggagttcgggttcggggacctcgtaccccgttgggttccttacgttcgtacttccgtcgtcgggggccgtcggg

SEQ ID NO: 409072 - DNA, 567 bp, Homo sapiens
  misc_feature: GZ8MTXP02HPHAL.3.82.H05.1.454.CMB.2.raw
  modified_base (332)..(332): a, c, t, g, unknown or other
  modified_base (415)..(415): a, c, t, g, unknown or other
  modified_base (420)..(420): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgaggggaaggggctgggagtgggtctntagttattacaattctgtaccacatacctactcccgacccgtgaacggccgtataaccatcctccagagacgatccgagaacncggtntatctacaatgaacactgagagccgacacgacggtcctttaatactgtgacgagagtacgtttcggaggttcggggttaccgggaccctccgtaccccgttggtttaacctacgttcgtacttccgtcggtcgggggtccgtccggg

SEQ ID NO: 409073 - DNA, 539 bp, Homo sapiens
  misc_feature: GZ8MTXP02JD37H.3.82.H05.1.454.CMB.2.raw
  modified_base (347)..(347): a, c, t, g, unknown or other
  modified_base (389)..(389): a, c, t, g, unknown or other
  modified_base (403)..(403): a, c, t, g, unknown or other
  modified_base (407)..(407): a, c, t, g, unknown or other
  modified_base (414)..(414): a, c, t, g, unknown or other
tcagagacgcactccacgaccggtgctcgatttagtcgagctctctcgcgggggagaggagcccagcactgggattccgaggtgtttccattcggtgatcagcactgaacacagaggactcaccatggagttttggctgagcgtggtttcctgttgctattcaaaggtgtccagtgtgaggtgcaggtggtggagactggaggaggcttgatccagccgtgggggtccctgagactctcctgtgcagcctctggcttcaccgtcagtagcagctacatgcatgggtccgccaggctccgagggaaggggctgggagtgggtctcgagttattacaattctgtaccanatactactccgacccgtgaagggccattaaccatctccaganacgatccgagaacncgtntatctanaatagaacacagagacgacgacgacgacgtacgttacttactagtgacgagtacgtagtacgtacgtcggtacggtaccgtaccgtaccgtcgttcgtcgttacgtactcgtcgtcggtcggtcg

SEQ ID NO: 409074 - DNA, 597 bp, Homo sapiens
  misc_feature: GZ8MTXP02GX01B.3.82.H05.1.454.CMB.2.raw
  modified_base (249)..(250): a, c, t, g, unknown or other
  modified_base (259)..(259): a, c, t, g, unknown or other
  modified_base (270)..(270): a, c, t, g, unknown or other
  modified_base (312)..(312): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcgtggtttcgtgtaggctattacaaaggtgtcagtgtgaggtgcaggtggtggagactggaggaggcttgatccagccgtggggggtccctgagactctcctgtgcnnctctgctcncgcagtagcanctacatgcacgtcggtccgccgcgcgcgagggagggcgtggnggtggtcgtcgtagttattactactcgtacgtactactactactacctccgtacccgtacgacggaccgtactaactactactacacgacgacgtacgtacgacgaacgacgtacgtacttactactaaactaacgaacaacgtacgagacgaccgaacgaccgtaccggtacgtttacgttacgtagtacgacgagtacgtacgtacggtacggtcgggtacgggtaccgtaccgtaccgttcgttaacgttacgttacgtacgtcgtcggtcgggtcggtcgg

SEQ ID NO: 409075 - DNA, 611 bp, Homo sapiens
  misc_feature: GZ8MTXP02F07W5.3.82.H05.1.454.CMB.2.raw
  modified_base (413)..(413): a, c, t, g, unknown or other
  modified_base (419)..(419): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccagccgtgggggtccctgagactctcctgtgcagcctctggcttcaccgtcagtagcagctacatgcacgtggtccgcaggctccgaggggaagggctgggagtgggtctcgagttattacaattctgtacacatactactccgaccccgtgaaacgggccattaaccatctacagagacgatccgagtaacncggttntaatcttaacaaattacgaaacaaaccgtgaacgacgacccgaaacgaacccgacgggtacccttttaagttaactggtagcggaagtaggaacttttcgggaaggttcggggttaccgggggtaccctacgtacccccgttggtttaaccctacgtttcccggattccgttcgtcgggggtcccgttcggg

SEQ ID NO: 409076 - DNA, 548 bp, Homo sapiens
  misc_feature: GZ8MTXP02I01AL.3.82.H05.1.454.CMB.2.raw
  modified_base (300)..(300): a, c, t, g, unknown or other
  modified_base (407)..(407): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtgggtccnccaggctccgaggggaaggggctggagtggggtctcagttatttacaattctggtaccacatactactccgaccccgtgaacgggccgaattaaccatctccaaganacgattccgagaacacggtagatcttacaaatgaaacaacctgaagagacccgacgacacggccgtttatactgtgacgagagtactacgaggtgtaccggggacctcgaacccgttggtactactcgactcgtcgtcggg

SEQ ID NO: 409077 - DNA, 546 bp, Homo sapiens
  misc_feature: GZ8MTXP02G3SUY.3.82.H05.1.454.CMB.2.raw
  modified_base (352)..(352): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccgccaggctccgaggggaagggctgggagtgggtctcagttatttacaattctgtaccanatactactccgacccgtgaacggccgattaaccatctccagagacgattccgagaacacggtgtatcttacaaatgaacaacctgaagacgccgaacgacgacggtccgtttatacgtgtagcgagacgagttcgaggtcggttacggggacctacgactacgtggttactacttcgatctcgtcggggtcccg

SEQ ID NO: 409078 - DNA, 553 bp, Homo sapiens
  misc_feature: GZ8MTXP02IBYWT.3.82.H05.1.454.CMB.2.raw
  modified_base (396)..(396): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggtagttttggctgagcttgggtttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactggtccgccaggctccgagggaggggctggagtgggtctcagttatttacaattctggtaccacatactactccgaccccgtgaacgggccgaattaaaccactcncccagagacgattcccgaagtaacacggtagtatcttacaaatgaaactaacctgaacgagaccgacgacgacggaccgttttatacgtgtgacgagagattcgagttcggtcgggtacctcgaacccgtggtactacgttcgacttctcgtcgggg

SEQ ID NO: 409079 - DNA, 497 bp, Homo sapiens
  misc_feature: GZ8MTXP02IU37Z.3.82.H05.1.454.CMB.2.raw
  modified_base (430)..(430): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaagtgagtcccatccagattcagcgtcagtgatctagggacagtagttcactctcaccatcagcagcctgcagcctgaacgtattttgactaactttactattgtacaacaggctgacagtcnccgctctacgtttcggcggtagggaccgaggtacggagataacgaaaacgaactggtgactgacaac

SEQ ID NO: 409080 - DNA, 574 bp, Homo sapiens
  misc_feature: GZ8MTXP02F1MQ9.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccgccaggctccgaggggaggggctgggagtgggtctcgagttattacaattctgtaccacatactactccgacccgtgaacgggccattaaccatcctccagagacgattccgaagaacacggtgtaattcttacaaaattcgaaaccaaacctgagacgacccgaagaccacggtaccgtttatacgtgtagcgagagtacttcggaggtggggttccggggacccttcgaccccgttggttcctaacgttcgtacttccgtcggtcgggggccttacggg

SEQ ID NO: 409081 - DNA, 536 bp, Homo sapiens
  misc_feature: GZ8MTXP02J04K4.3.82.H05.1.454.CMB.2.raw
  modified_base (296)..(296): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccnccaggctccgaggggaaggggctgggagtgggtctcagttatttacaattctggtaccacatacctactccgaccccgtgaacgggccgattaaccatctccagagacgacttccgagacacggtgtatcttacaaatgaaacacctgagagccgacgacacggtacgtttatactgtgcgagagattcgaggtggtcgggactcgaccctggtctacttcgactcgtcgtcggggctcg

SEQ ID NO: 409082 - DNA, 784 bp, Homo sapiens
  misc_feature: GZ8MTXP02IRNCZ.3.82.H05.1.454.CMB.2.raw
  modified_base (271)..(271): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcgtggtttcgtgtaggctattcaaaaggtgtccagtgtgaggtgcaggtggtggagactggaggaggcttgatccagccgtgggggtccctgagactctcctgtgcagcctctggcttcacccgtnagtagcagctacatgcgtacggtcgggtcccgccgacggccgtaccgggaaggggaacggggtcgtaggggtacggttcggggtaccttacggttaagttttaacctttaacgttaacgtttcgtaacggttaaccctaacttaacgttacccgttaacccgtacccccggtaacccccggtagggaaacccggggtacccgtaaacctttaaaccctacttacccgtacccgaaacggaacggtaaaccgttaccgttaacccggaaacggtaaaccgtaaccgggttattacgttaaccttaaacgtaaaacgtaccgaaaacctaaccgtaggaaaccggaaccgacccggaaccgaaccggttaaccgggttaccttttaagtacgtggtacggtacggtaagtacgttacggtttacgggacgggtttaccgggggttacccggtacccttaccgtaacccggtttcggttaccttacgttaccgtacgttccggttcgggtccgggg

SEQ ID NO: 409083 - DNA, 556 bp, Homo sapiens
  misc_feature: GZ8MTXP02G65QY.3.82.H05.1.454.CMB.2.raw
  modified_base (399)..(399): a, c, t, g, unknown or other
  modified_base (413)..(413): a, c, t, g, unknown or other
  modified_base (472)..(472): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggcctccgaggggaaggggctgggagtgggtctctagttatttacaactttctgtaccacatactactccgacccgtgaacggcattaacatctacaganacgactcgagaacncggtgtatcttacaaatagaacaacctgagagccgaacgacaccggaccgtttattacngtgcgagagacgttcgagttcgggttaccggggacctcgacccgttggttcctacgttcgacttcgtcgtcgggggtccgtcgg

SEQ ID NO: 409084 - DNA, 574 bp, Homo sapiens
  misc_feature: GZ8MTXP02GE04H.3.82.H05.1.454.CMB.2.raw
  modified_base (431)..(431): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccgccaggcctccgaggggaaggggctgggagtgggtctcgtagttatttacaacttctggtaccactatacctactcccgacccgtgaacgggccaattaaccatctccagacgacgattccgaagaacgacggtntactcttacaaatagaaacacctgagacgaccgacgaccgacggtcctttaatacgtgtacgacgtagagtgttacggagttcgggtacgggacctccgacccgttggttctacgttcgacttccgtcgtcgggggcctcggg

SEQ ID NO: 409085 - DNA, 549 bp, Homo sapiens
  misc_feature: GZ8MTXP02JYBM5.3.82.H05.1.454.CMB.2.raw
  modified_base (300)..(300): a, c, t, g, unknown or other
  modified_base (398)..(398): a, c, t, g, unknown or other
  modified_base (429)..(429): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtcccnccaggctccgaggggaaggggctgggagtgggtctcgagttattacaattctaggtaccacatactactcccgaccccgtgaacgggccattaaaccntcctacagagacgattaccgagaacacggtnatctacaaatgaacaactgagacgaccgacgacgacggtcgtttatacgtgtacgcgagagactcggagtcgggtccgggacctcgaacccgtggttcctacttcgacttcgcgtcgggg

SEQ ID NO: 409086 - DNA, 538 bp, Homo sapiens
  misc_feature: GZ8MTXP02FZQP8.3.82.H05.1.454.CMB.2.raw
  modified_base (432)..(432): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgtcggttttaacagatggttagtctggtatcagcaagaaaccagggaaacgcccctagagttcctgatgtctgctgcactccacctgacaaaggtcgacgtccatccagtattcagcgtcagtgatcgtagggacagtagttcactctcacatcagcagcctgcacgcctagaacgttatttcgactaactttactattagtacaacgnggtctagaactcgtcctcccgctctacgtttcgggacgggtaacggaccgaaggtaggaacgtaagtaacgaaaaccggtaactggtacggctacggacctaaccg

SEQ ID NO: 409087 - DNA, 644 bp, Homo sapiens
  misc_feature: GZ8MTXP02HOR1H.3.82.H05.1.454.CMB.2.raw
  modified_base (476)..(476): a, c, t, g, unknown or other
  modified_base (488)..(488): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccagccgtgggggtccctgagactctcctgtgcagcctctggcttcaccgtcagtagcagctacatgcacgtcgggtccgccgacggcctaccggaaggggaacggggcgtaggggaggtggggtctacgtaagtttactttacgtaactttcgtacggtaccaactacttaccttaccgtccccggacccgtaggaacgggcctaacttaaccatcctaccagacgtacgacttacccgaagaaaccgtcgggttntaactccttaanaaagtacgaaacctaacctggaacgacgaccgaacgaaccgtacggtaccgtttaatacgtgtagacgaaggtacgtagttcggaacggttcgggtaccgggaccctcgtacccgttggttaacctcgttacgtctcgtcggtcggggtcctccgg

SEQ ID NO: 409088 - DNA, 563 bp, Homo sapiens
  misc_feature: GZ8MTXP02ITLWZ.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagtttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtcccgccaggctccgaggggaaggggctgggagtggggtctcgtagttactttacaattctggtaccacatactacctccgacccgtgacgggcgattaaccatctccagagacattccgagaacacggtgtactcttacaaattgaaactacctgagacgccgacgacacggtcgtttatactgtgtacgagagtattacggaggttcgggttaccggggaccctcgtaaccccgttggttacctacttcgacttccgtcgtcggggg

SEQ ID NO: 409089 - DNA, 567 bp, Homo sapiens
  misc_feature: GZ8MTXP02IUMN8.3.82.H05.1.454.CMB.2.raw
  modified_base (276)..(276): a, c, t, g, unknown or other
  modified_base (346)..(346): a, c, t, g, unknown or other
  modified_base (350)..(350): a, c, t, g, unknown or other
  modified_base (437)..(437): a, c, t, g, unknown or other
tcagagacgcactccacgaccggtgctcgatttagtcgagctctctcgcgggggagtcagacccagtcaggacacagcatggacatgagggtccccgctcagctcctggggctcttgctgctctggttcccaggttccagatgcgacatccagatgacccagtctccatcctccgtgtctgcatctggtaggggacagagtcgctatgacttgtcgggcgactcgacggttttaacagtatggttagtctggtatcagcaagaaaccagggaaacncccctagacgttcctgatgtctgctgcactccaccctgacaaagtcggactccatccagtattcagcgtnagtnagtcgtgggacagtacgttcactctacacatcagcagcctgcacgcctagaagtatttacgactaaactttatattacgtacaacgnggtactagactacgtcctcccgcttaccgtacgtttccggggacggtaaacggggaaccgtaaggggttacggaacgaactaaccggaaaaacgtaaccgttggtaacgggccttacggacccgtaaccg

SEQ ID NO: 409090 - DNA, 568 bp, Homo sapiens
  misc_feature: GZ8MTXP02G817U.3.82.H05.1.454.CMB.2.raw
  modified_base (396)..(396): a, c, t, g, unknown or other
  modified_base (416)..(416): a, c, t, g, unknown or other
  modified_base (421)..(421): a, c, t, g, unknown or other
  modified_base (446)..(446): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtgggtccgccaggcctccgaggggaggggctgggagtgggtctcgtagttattacattcgtgtaccactatacctactcccgaccccgtggaacggccgattaaccntctcagagacatcgaagacncggtntatctacaaatagaacaacgtgagngaccgagacacggtcgtttatactgtagcgagagtacgttcggaggttcgggttaccgggggaccttaccgtacccgttggttcctaacgttcggacttccgtcggttcgggggccgttcgg

SEQ ID NO: 409091 - DNA, 576 bp, Homo sapiens
  misc_feature: GZ8MTXP02I1276.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgaggggaggggctgggagtggggtctcgtagttacttacaatttctaggtaccactatacctacctcccgaccccgtgaacgggccgtaattaacccatcctaccagacgacgattaccgagaacacggtatatcttacaaatgaaacacctgaagacgccgaacgacgacggtacctttatacgtgtcgacgagagtacgttcggagttcgggttaccgggacctccgtaacccgttggttacctacgttcgacttcgtcggtcgggg

SEQ ID NO: 409092 - DNA, 540 bp, Homo sapiens
  misc_feature: GZ8MTXP02IRR5E.3.82.H05.1.454.CMB.2.raw
  modified_base (343)..(343): a, c, t, g, unknown or other
tcagagacgcactccacgaccggtgctcgatttagtcgagctctctcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtcctgagactctcctgtgcagcctctggcttcaccgtcagtagcagctacatgcactgggtccgccaggctccgaggggaaggggctgggagtgggtctcagttattacaattcngtaccacatactactccgacccgtgaacgggccattaaccatctcagagacgattcccgaagaacacggtgtactctacaaatgaaaccaacctgagacgccgaacgacacggtacctttataactgtagcgagagattcggagttggtcggggacctcgacccgttgtcctacgttcgactctcgtggggcctcgg

SEQ ID NO: 409093 - DNA, 540 bp, Homo sapiens
  misc_feature: GZ8MTXP02IXD5Q.3.82.H05.1.454.CMB.2.raw
  modified_base (425)..(425): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgtcggttttaacagatggttagtctggtatcagcagaaaccagggaaagcccctgagttcctgatgtctgctgcatcccacctgcaaagtggagtcccatccagattcagcgtcagtgaatcgtagggacagagttcactctcacatcagcacgcctgcagctagaagtatttgactaacttactattcgtacaacgnggctagacagttcctacccgctaccgtacgtttccgggacgggtacggggaacccgtaaggggtacggaacgtaacgttaaccgaaaaacggtaccgttaggtacgggtctacgg

SEQ ID NO: 409094 - DNA, 514 bp, Homo sapiens
  misc_feature: GZ8MTXP02GBPKQ.3.82.H05.1.454.CMB.2.raw
  modified_base (276)..(276): a, c, t, g, unknown or other
  modified_base (342)..(342): a, c, t, g, unknown or other
  modified_base (379)..(379): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaacncccctgagttcctgatgtctgctgcactcccacctgcaaagtgacgtccactccagattcagctcngtgaatcgtgggacagagttcactctcacatcagcancctgcacgcctagaagtatttgactaacttactattcgtacaacgaggctagactacgtcctcccgcttcgacgtttcgggacggtaacgggaccgaaggtggaagtacgtaacgaaacgacgtgtcggactacg

SEQ ID NO: 409095 - DNA, 551 bp, Homo sapiens
  misc_feature: GZ8MTXP02GHM60.3.82.H05.1.454.CMB.2.raw
  modified_base (421)..(421): a, c, t, g, unknown or other
  modified_base (447)..(447): a, c, t, g, unknown or other
  modified_base (454)..(454): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcacgtgggtccgccaggctccgaggggaaggggctgggagtgggtctcagttatttacaattctaggtaccactatactactccgacccgtgaacgggccataaccatctaccagagacgattccgaagaacacggtntactcttacgaaatgaaacaactganagccganacgacggcctttatacgtgtgacgagacgtattcgaggttggtacgggacctcgacccttggttctacgttacgacttcgtacgtcggggccttcgg

SEQ ID NO: 409096 - DNA, 590 bp, Homo sapiens
  misc_feature: GZ8MTXP02HDA4H.3.82.H05.1.454.CMB.2.raw
  modified_base (495)..(495): a, c, t, g, unknown or other
tcagagacgcactccacgaccggtgctcgatttagtcgagctctctcgcgggggggagaggagcccagcactgggattccaaggtgtttccattcggtgatcagcactgaacacagaggactcaccatggagttttggctgagcttgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccgaggcctccggaggggaaggggcgtgggaggtgggtctcgtagtttaatttacaactttcgtacggtaccacatactacctcccgacccgtgaacgggccaattaaccatcaccagacgacgatccgaagaaccacggtgtacttcttacaaatacgaaacaaaccgtgagacgaccgacacgacgtctttatcngtgacgagagtagtcggaggttcgggttaccggggtacctccgtacccgttcggttaacttacgttcgacgttccgtcggtcgggggtccctggg

SEQ ID NO: 409097 - DNA, 617 bp, Homo sapiens
  misc_feature: GZ8MTXP02FYFIE.3.82.H05.1.454.CMB.2.raw
  modified_base (297)..(297): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcgtgggttttccttgttgctatttcaaaggtgtccagtgtgaggtgcaggtggtggagacgtggaggaggcttgatccagccgtgggggtccctgagactctcctgtgcagcctctggcttcaccgtcagtagcagctacatgcacgtgggtccnccgaggctccgaggggaggggctgggagtgggtctcgagttatttacaattctgtaccactatacctacctccgaccccgtaggaacgggccgtattaaccgatcctacccgaagacgacgacttaccggaagtaaaccgacgggtattactacttacaaaattacgaaacctaaacctgaacgacgcccggaacgaccgacgggttctttaagtactgagtcggaagacgtattacgggtagttcggggttccgggcctaaccgtccgtacccgttgggttacctaccgtttcggactttcgtcggttcggggtcccgg

SEQ ID NO: 409098 - DNA, 521 bp, Homo sapiens
  misc_feature: GZ8MTXP02JCJN8.3.82.H05.1.454.CMB.2.raw
  modified_base (356)..(356): a, c, t, g, unknown or other
  modified_base (470)..(470): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactgggtccgccaggctccgaggggaaggggctgggagtgggtctcgagttatttacaattctggtaccanatactactccgacccgtgaagggccgattaaccatctccagagacgatccgagaacacggtgtatctacaaatagaaacaacctgagagccgagacacggctttatactgtcgngagagattcgagtggtcgggactcacctgtctactcgatctcgtgggctcg

SEQ ID NO: 409099 - DNA, 588 bp, Homo sapiens
  misc_feature: GZ8MTXP02HZB5S.3.82.H05.1.454.CMB.2.raw
  modified_base (296)..(296): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccnccaggcctccgaggggaaggggctgggagtgggtctctagttatttacaattctcggtaccacatacctacctcccgaccccgtaggaacgggccgaattaaccatcctaccagagacgattccgaagaacacggtgtactcttacaaatacgaaacaacctgaagacgccgaacgacacggtacctttatactgtgcgtagagtacgttcggaagttggggttaccggggacccttacgaccccgttgggttccttaacgttcgacttccgtcggtcgggggtcccgtcgg

SEQ ID NO: 409100 - DNA, 535 bp, Homo sapiens
  misc_feature: GZ8MTXP02IQ73I.3.82.H05.1.454.CMB.2.raw
  modified_base (295)..(295): a, c, t, g, unknown or other
  modified_base (415)..(415): a, c, t, g, unknown or other
  modified_base (420)..(420): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactgggtccnccaggctccgagggaaggggctgggagtgggtctcagttatttacaattctggtaccacatactactccgacccgtgaacgggccgattaaccatctaccagagacgattccgaagaacncggtntatctacaaatgaaacacctgagacgccgacgacacggtccgtttatactgtgcgagagattcgagtgggttcgggactcgaccgtggttctactcgtatctcgtcggggctcgg

SEQ ID NO: 409101 - DNA, 621 bp, Homo sapiens
  misc_feature: GZ8MTXP02JLYP6.3.82.H05.1.454.CMB.2.raw
  modified_base (295)..(295): a, c, t, g, unknown or other
  modified_base (422)..(422): a, c, t, g, unknown or other
  modified_base (428)..(428): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactgggtccnccaggctccgaggggaagggctgggagtgggtctcgagttatttacaattcgtggtaccacatactactccgacccgtgaaacggggccaattaaccgatctaccagtacgacgattccgagaaacncgggtntaactcttacaaaagttcgaaacaaaccgtgaacgacgacccggaacgaccacgggtcccttttaataccgtggtgacggaaggtaacgtacgtttacgggaacggttggggtttacccgggggaaccttccggtacccccgttaaggggtccttaacgttcggaacttccgtcgttcgggggcccgttcggg

SEQ ID NO: 409102 - DNA, 516 bp, Homo sapiens
  misc_feature: GZ8MTXP02II213.3.82.H05.1.454.CMB.2.raw
tcagagacgcactccacgaccggtgctcgatttagtcgagctctctcgcgggggcaggagtcagacccagtcaggacacagcatggacatgagggtcccgctcagctcctggggctcctgctgctctggttcccaggttccagatgcgacatccagatgacccagtctccatcctccgtgtctgcatctgtaggggacagagtcgctatgacttggtcgggcgactcgcggttttaacagattggttagtctggtatcagcagaaaccagggaaacgcccctgagttcctgatgtctgctgcatcccaccctgcaaagtgatcccatccagattcagcgtcagtgaaatcgtagggacaggacgttcactctcacatcagcacgcctgcagcctagaagtatttcgactaacttactattgtacaacaggctagacacgtcctccgctctacgtttcggacggtacgggaacctaaggtaggaagacgtaacgaaaacgtaacgtgtacggctacg

SEQ ID NO: 409103 - DNA, 542 bp, Homo sapiens
  misc_feature: GZ8MTXP02HTP9W.3.82.H05.1.454.CMB.2.raw
  modified_base (355)..(355): a, c, t, g, unknown or other
  modified_base (421)..(421): a, c, t, g, unknown or other
tcagagacgcactccacgaccggtgctcgatttagtcgagctctctcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgaggggaaggggctggagtgggtctcgtagttattacaattctagtaccanatacctactcccgacccgtgaacgggccaattaaccatcctcagagacgatccgagaaacacggtntactcttacaaatgaaacaacctgaagagaccgacgacacgggtcctttaatactgtgacgagagattcgagtggttcgggacctcaccctgttctacttcgactcgtcgtggggcctcgg

SEQ ID NO: 409104 - DNA, 583 bp, Homo sapiens
  misc_feature: GZ8MTXP02HAWXP.3.82.H05.1.454.CMB.2.raw
  modified_base (257)..(257): a, c, t, g, unknown or other
  modified_base (297)..(297): a, c, t, g, unknown or other
  modified_base (436)..(436): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctntggcttcaccgtcagtagcagctacatgcacgtgggtccnccgaggcctccgaggggaaggggctgggagtgggtctcgtagttattacaattctagtaccatatacctactcccgacccgtggaaacgggtcctaattaaccatcctaccagacgacgacttaccgagaaccacggtntaatctacaaatgaaacaaacctgaagacgaccgaacgaccacggtaccgtttatacgtcgtagcggaatagtcgtaggacggttcggggtaccggtacctaccgtcgttcgtcttacgtacgtcttcgtcgggtcgggtcgtccgg

SEQ ID NO: 409105 - DNA, 683 bp, Homo sapiens
  misc_feature: GZ8MTXP02HB0LC.3.82.H05.1.454.CMB.2.raw
  modified_base (356)..(356): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgtgctattcaaaggtgtccagtgtgaggtgcaggtggtggagacgtggaggaggcttgatccagccgtgggggtccctgagactctcctgtgcagcctctggcttcaccgtcagtgcagctacatgcacgtgggtccgccaggcctccgaggggaaggggctgggaggtgggtctcgtagttattacaattctagtaccanatacctactccgacccgtagaacggccgtaattaaccatcctaccgaagtacgacgaacttccggaaagaaacgtacgggtataacttacttaaacaaaagttacgaaaacctaaaccgttaggaacgaacggacccggaaaccgaaaccgtaaccggggttacccttttaaagttaaccgttggttacggaccggtaaaggtaacggttacgtttacgggaaacggttcgggggtttaacccgggggacccttacccgtaaccccggtttgggttaacccttaacggttcgacgtttccgttcggtacgggggtcccgttaccggg

SEQ ID NO: 409106 - DNA, 594 bp, Homo sapiens
  misc_feature: GZ8MTXP02FWV25.3.82.H05.1.454.CMB.2.raw
  modified_base (394)..(394): a, c, t, g, unknown or other
  modified_base (429)..(429): a, c, t, g, unknown or other
  modified_base (490)..(490): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcgtgggttttccttgttgctatttcaaaggtgtccagtgtgaggtgcaggtggtggagactggaggaggcttgatccagcctggggggtccctgagactctcctgtgcagcctctggcttcaccgtcagtagcagctacatgcactgggtccgccaggctccgaggggaaggggctgggagtggggtctcagttattacaattctgtaccacatacctactccgaccccgtggaacgggccgattaaacccnctccacagacgacgtactaccgaagacgtacggtntaacttctaacaaatacgaaaccacgtgagacgaccgaacgacgtacggtactttatacgngtcgacgtagtacgtagttacggaggttcgggtaccggacccttaccgtacccggtttggttaaccttacgttcgtacttccggtcggtcggggtcccgtacgg

SEQ ID NO: 409107 - DNA, 538 bp, Homo sapiens
  misc_feature: GZ8MTXP02FSHDS.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccgaggggaaggggctggagtgggtctcagttatttacaattctgtacacatactactccgacccgtgaaaggccgattaaccatctcagagacgattccgaagaacacggtgtaatcttacaaaatgaaacaaacctgagagaccgaagaaccacggccgtttaattactgtgcgagagattgagtggttcggggacctcaccctggttctacttcgatctcgtggggccgtgg

SEQ ID NO: 409108 - DNA, 604 bp, Homo sapiens
  misc_feature: GZ8MTXP02JA2R2.3.82.H05.1.454.CMB.2.raw
  modified_base (253)..(253): a, c, t, g, unknown or other
  modified_base (266)..(266): a, c, t, g, unknown or other
  modified_base (276)..(276): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcggtggtttcgtgtaggcgtacttataaaaggtgtcagtgtgaggtgcaggtggtggagctggaggaggcttgatccagccgtgggggtccctgagctctcctgtgcncgctctcgtctcncgtcagtgcngctacagtgcacgtcggtccgcgcgcgcgacgggagggcggtggtaggtcggtcgtcgtagttacgttacgtacgttacgtacgtacctactactacctaccgtacccgtaccgtacggtaacggtacgtaactaaccgtactacgtaccgacgacgacgtacgtacgaacgaacgtacgtacgtactactactaacgtacgtaactacgtagacgacgacgacgacgtacgtacgttacgtacgtgtgacgtagtagtacgtacgtacggttacggtacggtaccgtccgtaaccgttcgttacgttacgtacgtcgtcgtcgtcgg

SEQ ID NO: 409109 - DNA, 686 bp, Homo sapiens
  misc_feature: GZ8MTXP02IJKW1.3.82.H05.1.454.CMB.2.raw
  modified_base (292)..(292): a, c, t, g, unknown or other
  modified_base (358)..(358): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcgtggtttcgtgtagctattacaaaggtgtccagtgtgaggtgcaggtggtggagactggaggaggcttgatccagccgtgggggtccctgagactctcctgtgcagcctctggcttcacgtcagtagcagctacatgcacgtgggtccnccaggcctaccgaggggaacggggctgggagtgggtctcaagttattacaatttcgtaggtaccanattacctacctcccggtacccgtaggaaacgggcctaacttaacacttccgaccaaggaacgacggtacttacccggaaagaaaccgtacggggttataaactttcccttaaaacgaaaacgtacgaaaaccctaacgtaggaaacgaccggtaccggaaaccgtaacgtaccggttacgtttaagtaccgtaggtacggacgtaagtacggttagtttacgggtaacgggtttccggggttacccgggtacctaccgtaacccggtttacggtttaaccgttaccgttacgtacgtccggtttccgggtacgggggtcccgttcggg

SEQ ID NO: 409110 - DNA, 564 bp, Homo sapiens
  misc_feature: GZ8MTXP02JLW7A.3.82.H05.1.454.CMB.2.raw
  modified_base (361)..(361): a, c, t, g, unknown or other
  modified_base (393)..(393): a, c, t, g, unknown or other
  modified_base (396)..(396): a, c, t, g, unknown or other
  modified_base (419)..(419): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtgggtccgccgaggcctccgaggggaaggggctgggagtgggtctcgtagttatttacaattctagtaccanatactactccgacccgtgacggccattaaccntcncagagacatccgaagacacggtntatctacaaatgaaacaacctgagacgaccgaacgtacgacgggtaccctttattaccgtgtacgcgaagacgtagttcggaggttcgggtccggggacctccgacccgttggttcctacttcgactccgtcgtcggggcctcgg

SEQ ID NO: 409111 - DNA, 688 bp, Homo sapiens
  misc_feature: GZ8MTXP02ITC1O.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtcctgagactctcctgtgcagcctctggcttcaccgtcagtagcagctacatgcacgtggccgcaggctccgaggggaagggctgggagtgggtctcagttattacaattctggtaccatattaacctacctcccggaccccgttaggaaacggggtacccgtaacttaaaccgacttacctcccgaagaacggaaccgtattacccggaagaaaaccgtccggggttattaacttcctttacgaaaattacggaaaaccctaaacccgttggaacggaaccgacccggaaaacccggaacgtacccggggttacccgttttaatttaacccgtggttacggacggtaagtaggtacttttacgggacgggtttacggggttccgggttaaccctccgtaccccgtttggtttaaccctacgtttcggtacttcggtccgtcgggggacccgtcggg

SEQ ID NO: 409112 - DNA, 599 bp, Homo sapiens
  misc_feature: GZ8MTXP02IRN9L.3.82.H05.1.454.CMB.2.raw
  modified_base (281)..(281): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttggtcgggcgactcggtacggttttaacagtatggttagtctggtatcagcagaaaccagggaaacncccctgagttcctgatgtctgctgcactcccacctgacaaagtgacgtccatccagtacttcagtcgtcaggtagaatcgtaggactagtacgttcactctacacatcagcacgctgcacgctagaagttatttacgacttaactttactattcgtacaaacgaggtactacgtaacgtacgtacccttaccccggccttaccggttaccggttttacgggggaccggggtaacggggtaaacccgtaaagggggtacggtaaacgtaacgttaaaccggtaaaaaccggtacgttacgggttacgggaacttaccgg

SEQ ID NO: 409113 - DNA, 547 bp, Homo sapiens
  misc_feature: GZ8MTXP02F3F5T.3.82.H05.1.454.CMB.2.raw
  modified_base (410)..(410): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccgccaggctccgaggggaggggctgggagtgggtctcagttattacaattctgtaccacatactactccgacccgtgaacggccattaaccatctccgagacgacgattccgagaacncggtatatctacaaatgaaacaacctgagacgccgaacgaccacggtccgtttaatacgtgtagcgagagtagttcggaggttcggttccggggacctcgacccgttggtctacttcgatcgtcgtcggggcctcgg

SEQ ID NO: 409114 - DNA, 557 bp, Homo sapiens
  misc_feature: GZ8MTXP02JG6D9.3.82.H05.1.454.CMB.2.raw
  modified_base (288)..(288): a, c, t, g, unknown or other
  modified_base (354)..(354): a, c, t, g, unknown or other
  modified_base (360)..(360): a, c, t, g, unknown or other
  modified_base (363)..(363): a, c, t, g, unknown or other
  modified_base (374)..(374): a, c, t, g, unknown or other
  modified_base (458)..(458): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgtacttggtcgggcgacgtcggtacggttttaacagtagttggttagtctggtatcagacaagaaaccgaggaaacncccctgacgttcctgatgtctgctgcactcccacctgacgaaagtcggactccactccagtatacngtctcngtnaagtcgagganagtattcactctacaccatacagcacgcctgacacgcctaaggtaacttatttacgacttaaacttacgttatacgaactaagnggactacgactcgtccctacccgcttacgtacggttcgggacggacggaacgtagggtagaacgaacgtaaccgaaaacgtcgtcgggtacgtacgacg

SEQ ID NO: 409115 - DNA, 850 bp, Homo sapiens
  misc_feature: GZ8MTXP02HUNV6.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtgggaggaggcttgatccagccgtgggggtccctgagactctcctgtgcacgcctctggcttcaccgtcagtagcagctacatcgcacgtcgggtccgccgaggccgtacccggagggggaacggggcgtgggtaggtcgggttctcgtaaggtttaactttaacctaacgtttccgtacgggttaacccaacgtaacttaacccgttaaccgttcccccgggaacccccggttagggaaaaccgggggtacccccgttaaatttaaacccccgaattcccgtacccgaaaggaaccggtaaccgtaacgtttacccgggaaacgtaaaaccgtaaccgggggttagttaacttaccttaacaaaaacgttacggaaaacccctaaaccgttagggaaacggaaccgggtaccccggaaacccggaaaccgtaacccgggggtttacccgtttttaaatttaaccggttgggtacgggtaaccggtaaagggttaacggtaacggttttaccggggaacgggttttccgggggtttaacccgggggacccctttacccggtaacccccgttttgggtttaaccctttaaccgttccgggtttaactcccggtttacccgggttcgggggtaccccggtttaccggg

SEQ ID NO: 409116 - DNA, 586 bp, Homo sapiens
  misc_feature: GZ8MTXP02IVBWR.3.82.H05.1.454.CMB.2.raw
  modified_base (434)..(434): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctggcttcaccgtcagtagcagctacatgcacgtcgggtccgccgaggcctaccgaggggaacggggctgggagtgggtctcgtagttattacattctagtaccactatacctactcccgacccgtagaacggcctaattaaccatcctaccagacgacattaccgaagaacacggtntactctacaaatagaaaccaactggagacgaccgaacgacgaccggtaccgtttatacgtgtacgacgaagtagagttcggaggttcgggttaccgggacctccgtacccgttggttcctacgttcgactcgtcggtacgggggtccgtcgg

SEQ ID NO: 409117 - DNA, 603 bp, Homo sapiens
  misc_feature: GZ8MTXP02G2WXQ.3.82.H05.1.454.CMB.2.raw
  modified_base (435)..(435): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagactggaggaggcttgatccagccgtgggggtccctgagactctcctgtgcagcctctggcttcaccgtcagtagcagctacatgcacgtcgggtccgccgaggcctccgaggggaaggggcgtgggaggtggggtctcgtagttatttacaattctgtaccactatacctactcccgacccgtggaacgggccaattaaccatcctaccagacgacacttccgaagaactacggtntatcttacaaatgaaacaactgagacgaccgaacgacaccggtacgtttataccgtgtacgacgaagtagtacgttacggtacggttcgggttaccggggacccttccgtaacccgtttgggtttcctacgtttccgtacttccgttcggtcgggggtcccgttccgg

SEQ ID NO: 409118 - DNA, 586 bp, Homo sapiens
  misc_feature: GZ8MTXP02HD2WC.3.82.H05.1.454.CMB.2.raw
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgtcggttttaacagtatggttagtctggtatcagcagaaaccagggaaacgcccctgacgttcctgatgtctgctgcactcccacctgaccaaagtggacgtccactccagtattcagtcgtcaggtgaacgtccggggaactagtacgttcacttcctacaccctataccagaccacgtcctgaccagtaccgtagaaacgttattttacgacctttaaactttaacttagtttacgtaccaaacgtggtactcgaccgtacgtccctcccgtactaccgtaccggtttccgggacgggtaacgggaccgaagggtcggaagtaacgtaacgaaacgtacgtggtacggactacgacc

SEQ ID NO: 409119 - DNA, 576 bp, Homo sapiens
  misc_feature: GZ8MTXP02J1N07.3.82.H05.1.454.CMB.2.raw
  modified_base (445)..(445): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgacgactctcctgtgcagcctctggcttcaccgtcagtagcagctacatgcacgtcgggtcccgccgaggcctccggaggggaacggggctgggagtggggtctcgagtttactttacaattctaggtaccacatacctactcccggacccgtgaacgggccgtaattaacccatcctacagacgacgtatccgagaacgacggtntatcttacaaatgaacactgacgagccgacgacacggtcgttatcgtgtgcgagagacgttcgaggttcgggtaccggggaccttaccgaacccgttggttacctacgttcgacttccgtcggtccggggg

SEQ ID NO: 409120 - DNA, 544 bp, Homo sapiens
  misc_feature: GZ8MTXP02GDMDO.3.82.H05.1.454.CMB.2.raw
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttggtcgggcgactcgtcggttttaacagtatggttagtctggtatcagcaagaaaccagggaaacgcccctgacgttcctgatgtctgctgcactcccacctgacaaagtggacgtccactccagtattcagcgtcagtgaatcgtaggggacaggtacgttcactctacacatcagcacgctgcagctagaagttatttacgactaactttactattcgtacaacaggtctagactagtcctaccgcttcgtacgtttcgggacgggtacgggaaccgaagggtaggaacgtacgtaaccgaaaacgtacgtacggtacggtcgtacg

SEQ ID NO: 409121 - DNA, 562 bp, Homo sapiens
  misc_feature: GZ8MTXP02HPXWO.3.82.H05.1.454.CMB.2.raw
  modified_base (299)..(299): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccnccgaggctccgaggggaggggcgtggagtgggtctcgagtttacttacaattcgtaggtaccactatacctactcccgacccgtgaacgggccgaattaacccatccacctagacgacgtaattccgaagaacacggtgtactacttacaaattgaaacctactagacgagcagacgacacggtacgtttatacgtgtcgacgagagattcgaggttcggtcgggacctcgtaccgtcggttacctacgttcgacttcgtcgg

SEQ ID NO: 409122 - DNA, 551 bp, Homo sapiens
  misc_feature: GZ8MTXP02FQ5WQ.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactcgggtccgccaggctccgaggggaaggggctgggagtggggtctcgtagttatttacaatttctggtaccacatacctactccgaccccgtgaacggccgattaacccatctcccagacgacgattccgagaacacggtgtatcttacaaatgaacactgagagaccgacgacacggtccgtttataccgtgtgcgagagtacttcggagtcgggttccgggactcgaacccgtggttactacgtcgactcgtcgtcgggg

SEQ ID NO: 409123 - DNA, 575 bp, Homo sapiens
  misc_feature: GZ8MTXP02JBURF.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgaggggaaggggctgggagtgggtctcgtagttatttacaattctggtaccacatacctactccgacccgtgaacgggccattaaccatcctaccagacgacgattaccgaagaaccgcggtagtactctacaaatcgaaaccaccgtgagacgaccgaacgacacggtccgtttaatcgagtcgacgagtacgattcggaggttcgggttacggggacctccgaacccgttggttcctacgttcgacttccgtcgtcgggggccgtcgg

SEQ ID NO: 409124 - DNA, 567 bp, Homo sapiens
  misc_feature: GZ8MTXP02JYWZO.3.82.H05.1.454.CMB.2.raw
  modified_base (352)..(352): a, c, t, g, unknown or other
  modified_base (379)..(379): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttggtcgggcgactcggtacggttttaacagtattggttagtctggtatcagcaagaaaccagggaaacgcccctgacgttcctgatgtctgctgcactcccaccctgacaaaggtcggacgtcccatccagattcagcgtnagtgatcgtagggacagagttcactcncaccatcagcagcctgcagcctagaagttatttagacttaacttacttattagtacaacgagggctaggactacgtcctcccgtctaccgtacggtttccgggacggggtaacggggaaccgtaaggggtacggaacgtaacgtaaccgaaaacggtaacgtggtacggtccgtacggacctaacccg

SEQ ID NO: 409125 - DNA, 559 bp, Homo sapiens
  misc_feature: GZ8MTXP02H1PC3.3.82.H05.1.454.CMB.2.raw
  modified_base (426)..(426): a, c, t, g, unknown or other
  modified_base (434)..(434): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagccctctggcttcaccgtcagtagcagctacatgcacgtcgggtccgccaggcctccgaggggaaggggctgggaggtgggtctcgtagttatttacaattctggtaccactatacctactccgacccgtgacggccattaaccatactacagagacgataccgagaacacggtntatcttanaaatgaaactaacctgacgagccgacacgacggtcctttatactgtgcgagacgtagttcggaggtcgggttacgggacctcgtaccctggtttctacgttcgactccgtcgtcggggccgtcgg

SEQ ID NO: 409126 - DNA, 591 bp, Homo sapiens
  misc_feature: GZ8MTXP02GBU9N.3.82.H05.1.454.CMB.2.raw
  modified_base (276)..(276): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggagacagagtcaccatcacttggccgggcaagtcagagcattagcagtctatttaaattggtatcagcaagaaaccgagggaaacncccctaagctcctgatctatgctgcactcctagtttgacgtaaaggtcggggtacccccagtaccgtaaggttcaggtggacgtaggtggatcgtagggactagtactttcactctcaccatacaacagtctgactaacctagtaaacgtattttacgacttaaacttactaactacgtacaaacgtagtacgtttacctaaccttaccccttctaccgtaccggtttacggggaccgggggaaccgtaagggtacggaagtacgtaacgaaacgtaacgtggtacggacgtacgacctacctacttctttaccg

SEQ ID NO: 409127 - DNA, 736 bp, Homo sapiens
  misc_feature: GZ8MTXP02IRWU4.3.82.H05.1.454.CMB.2.raw
  modified_base (300)..(300): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgtgctatttcaaaaggtgtccagtgtgaggtgcaggtggtggagacgtggaggaggcttgatccagccgtgggggtccctgagactctcctgtgcagcctctggcttcaccgtcagtagcagctacatcgcacgtcggggtccnccgacggctaccggaggggaaggggcctaggggaggttcgggtctacgtaagtttaatttaactaaacttcgtacggtacccaataacttaaccgtacctccccggtaacccccgggttaggaaaaccggggtcccgtaaactttaaaccccgactttacccgtacccgaaagaaccggtaaccgtaaaccgtttacccggaaaagaaacccgtacggttagtaacttaccttacaaaattacgaaaaccttaaccgaggaacaggaccccggaaacgacggacccggttaccggtttaaattccgtggtacgacgaaggtaacgtagtttaaccgggaggttcggggttacccggggacccttacccgaacccctttggggttaacctaaccgttttacggacttccgttcccggtgggggtacccccttcgggg

SEQ ID NO: 409128 - DNA, 538 bp, Homo sapiens
  misc_feature: GZ8MTXP02IJJHK.3.82.H05.1.454.CMB.2.raw
tcagagacgcactccacgaccggtgctcgatttagtcgagctctctcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccgaggggaaggggctgggagtgggtctcagttatttacaattctggtaccacatactacctccgaccccgtgaaacgggccattaaccatctccagagacgattccgagaacacggtgtatctacaaatgaaacaacctgagacgccgacgacacggccgtttatactgtgcgagagattcgaggttggtcggggacctcgaccttggttctacttcgatctcgtcggggccctgg

SEQ ID NO: 409129 - DNA, 578 bp, Homo sapiens
  misc_feature: GZ8MTXP02IO4B2.3.82.H05.1.454.CMB.2.raw
  modified_base (297)..(297): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggtttccttgttgctatttcaaaaggtgtccagtgtgaggtgcaggtggtggagactggaggaggcttgatccagcctgggggtccctgagactctcctgtgcagcctctggcttcaccgtcagtagcagctacatgcacgtgggtccnccgaggctccgaggggaaggggctgggagtggggtctcgtagtttatttacattctaggtaccacatctactccgaccccgtgaacgggccgattaacccatcctaccagacgacgaacgttaccgagaacctacggtagtattccttacaaaattcgaaaactaacctgagacgccgaacgacgtacggtaccgtttattacgtgtggtacgagagacttcggagttcgggtaccgggacctcgaacccgttggttcctacgttcgacttctcgtcgggg

SEQ ID NO: 409130 - DNA, 560 bp, Homo sapiens
  misc_feature: GZ8MTXP02GMOO4.3.82.H05.1.454.CMB.2.raw
  modified_base (357)..(357): a, c, t, g, unknown or other
  modified_base (391)..(391): a, c, t, g, unknown or other
  modified_base (422)..(422): a, c, t, g, unknown or other
  modified_base (430)..(430): a, c, t, g, unknown or other
  modified_base (487)..(487): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgcaggctccgaggggaaggggctgggagtgggtctctagttatttacaattctggtaccanactactactcccgacccgtgaacggccataaccntctccagagacgtatccgaagaactacggtntactctanaaatacgaaacaacgtgagacgccgaagaccacggtctttaatctgtgacgagtagnttacggagttcgggtacggggaccctcgacccgttggttcctacgtttcggattccgtcgtcgggggcctcgg

SEQ ID NO: 409131 - DNA, 598 bp, Homo sapiens
  misc_feature: GZ8MTXP02ING3I.3.82.H05.1.454.CMB.2.raw
  modified_base (425)..(425): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgtgctattcaaaggtgtccagtgtgaggtgcaggtggtggagactggaggaggcttgatccagccgtggggggtcctgagactctcctgtgcagcctctggcttcaccgtcagtagcagctacatcgcacgtggggtccgcaggctaccgaggggaaggggctgggagtgggtctctagttatttacaattccgtgtaaccacatacctacctcccgaccccgtgaacggggccacttaacatcacagagacatcgaagaacacggttntatcttacaaatcgaaaccaaacccgagacgcccgtaacgaaccgtaccggttacgtttattacgtggtcgacgtaagagtacgtttccggaggtcgggggtttaccgggacctccgtaacccgttggtttaccttaacgttcgacttcgtacgtcgggggtcctgggtaccc

SEQ ID NO: 409132 - DNA, 586 bp, Homo sapiens
  misc_feature: GZ8MTXP02F9OQ9.3.82.H05.1.454.CMB.2.raw
  modified_base (430)..(430): a, c, t, g, unknown or other
  modified_base (448)..(448): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactgggtcccgccaggctccgaggggaaggggctgggagtggggtctcgtagttactttacaatttctacggtaccactatacctacctcccgaccccgtgaacgggccgtattaaaccatctccagacgacgattaccganaacgacggtgtatcttanaaatgaaacaacctgacgagcccgaacgacgacggtaccgtttataccgtgtgacgagagtacgttcgaaggttcgggttccggggacctaccgtaacccgttggttacctacgttcgacgttccgtcggttcggggg

SEQ ID NO: 409133 - DNA, 624 bp, Homo sapiens
  misc_feature: GZ8MTXP02FXNZR.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgaggggaagggcgtgggagtggggtctcgagtttatttacacttcgtcggtacactatacctactcccggaccccgtggaacgggccaattaaccatctccaagacgacgacttccgaagaacacggttgtaattcttaacaaagtacgaaaccaacctggaacgacgacccgacgaacccgacgggttaccgtttaattaccggtgtagacgaaaggtagtagtttccggaaggtttcggggttaccggggacccttaccgtaccccggttggttaacccttaacgttcgacttccgtcggtcgggggtcctaccggg

SEQ ID NO: 409134 - DNA, 570 bp, Homo sapiens
  misc_feature: GZ8MTXP02JEDUM.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtgcagctacatgcacgtggtccgcaggctccgaggggaggggctgggagtgggtctcgtagttatttacaacttctagtaccacatacctactcccgacccgtagaacgggaccgaattaaccatcctaccagacgacgattccgaagacacggtatatctacaaatagaaacacctagacgacgacgacgacacggtacttatacgtgtgcgagagtattcggacggtcgggtttaccgggaccttaccgacccgttcgttcctaccgttacgacttccgtcggtcggggccgttcgg

SEQ ID NO: 409135 - DNA, 712 bp, Homo sapiens
  misc_feature: GZ8MTXP02HK8YH.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctcgtggcttcaccgtcagtagcagctacatcgacacgtcgggtcccgccgaggcctaccggaaggggaacggggcgtgggaggtcgggtctacgtaagtttactttaacaactttcgttacggtaacctaactacttaacccgtacctacccccgggtaacccccggttagggaaaccggggtacccgtaaactttaaaccccgacttacccgtacccgaaaggaacgtaaccgtacgttaccccggaaagtaaaccgtacgggttacttaacttcctttaaaccaaaattaccggaaaacctaaaccgtaggaaacgaccgtacccggaaacgaccggtaccggtaccgttttaatacgtgtacgacgaagtagtacgttcggacggttcgggtaccgggacctcgtaccccgttggttaaccctacgttcgactcgttcggtcgggggtcctcgg

SEQ ID NO: 409136 - DNA, 617 bp, Homo sapiens
  misc_feature: GZ8MTXP02IPYDB.3.82.H05.1.454.CMB.2.raw
  modified_base (332)..(332): a, c, t, g, unknown or other
  modified_base (481)..(481): a, c, t, g, unknown or other
  modified_base (486)..(486): a, c, t, g, unknown or other
tcagagacgcactccacgaccggtgctcgatttagtcgagctctctcgcgggggagtcagccccagtcaggacacagcatggccatgagggtccccgctcagctcctggggctcctgctgctctggttcccaggttccagatgcgacatccagatgacccagtctccatcctccgtgtctgcatctggtagggacagagtcgctatgacttggtcggcgctcgacggttttaacagtagttggttagtcgtggtatcgagacgaacgaaaaccgaagggaccctcccctaggtacgttcctaggattcgtctggctcgctaacgtccccccncctacgtcgaaacgtcgacgtcccgactaccacgactacagtcgtacaggtacgtactcgtacgggtaacagtagttacgcctacgttacctaaccaactacacgcgacgaccgtcgacgacgccgtacgaacgtaactttacgtactnaaacnctttacgttacttacgttacctaaactaggtctacgaacgtacgttcgtacccgacgtacctaccgtttccggacggacggtaccgaacgggtagggaacgaacgtacgaaacgaacgtacgtacggactg

SEQ ID NO: 409137 - DNA, 570 bp, Homo sapiens
  misc_feature: GZ8MTXP02JK2HX.3.82.H05.1.454.CMB.2.raw
  modified_base (356)..(356): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgaggggaaggggctgggagtgggtctctagttattacaattctagtaccanactactactccgacccgtgaacgggccaattaaccatcctaccagagacgatccgaagaacacggtagtactcttacaaatagaaacaacctgagacgacccgaacgacgtaccggactttaagtactgtgacgaagaacgtagttcggaaggttgggttaccggggacctccgaacccgttggtctacgttcgatcgtcgtcggggccgtcgg

SEQ ID NO: 409138 - DNA, 597 bp, Homo sapiens
  misc_feature: GZ8MTXP02GKYC3.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggcctccgaggggaaggggctgggagtgggtctcgtagttatttacaattctaggtaccacatacctacctcccgaccccgtggaaacgggtccgaattaaccatcctaccgagacgacgtacttaccgaagacgacggtagtactcttacaaatagaaaccaacctgacgacgaccgacgacacggtactttatactgtagacgagagtacttggacggttacgggtccggggtacctccgtaacccgttgggtttaacctacgttcgtacgttccgtcggtcggggtccgtccggg

SEQ ID NO: 409139 - DNA, 542 bp, Homo sapiens
  misc_feature: GZ8MTXP02IR6CZ.3.82.H05.1.454.CMB.2.raw
  modified_base (280)..(280): a, c, t, g, unknown or other
tcagagacgcactccacgaccggtgctcgatttagtcgagctctctcgcgggggagtcaggcccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttggtcgggcgactcgtacggttttaacagtagtggttagtctggtatcagcaagaaaccgagggaaacncccctgacgttcctgatgtctgctgcactcccacctgacaaaggtcggactccccatccagtactcagcgtcagttgatcgtagggacagtacgttcactcacaccatcagcagcctgcagcctagaagttatttgacttaaactttactatttcgacaacgaggtactagactacgtcctccgcttcgtacgttcgggacggaacgggacctaggggtacgaagtaacgtaacgaaaacgtacgtggtcgactcgacaccg

SEQ ID NO: 409140 - DNA, 616 bp, Homo sapiens
  misc_feature: GZ8MTXP02GIF4N.3.82.H05.1.454.CMB.2.raw
  modified_base (427)..(427): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccgccgaggcctccgaggggaaggggctgggagtgggtctcgtagttatttacaatttctcggtaccacatacctactcccgacccgtgaacgggccaattaaccatctaccagagacgtattccgaagaacncggtgtaactcttacaaaatcgaaaacctaaaccgtggaacgacgacccggaaccgaaccgacgggtaccttttaatacgtgtacgacgtaaggagtacgtttacggaggttcgggggttacggggaacttccgtaccgtaacccgttggtttacctaacgtttcggacttcgtcggtcgggggtcccg

SEQ ID NO: 409141 - DNA, 549 bp, Homo sapiens
  misc_feature: GZ8MTXP02G3QGF.3.82.H05.1.454.CMB.2.raw
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgtcggttttaacagtatggttagtctggtatcagcaagaaaccgagggaaacgcccctgagttcctgatgtctgctgcactccaccctgacaaagtggacgtcccatccagtattcagctcagtgatcgtagggacagtagttcactctacacatcagcagctgcagctagaagtatttgactaactttactattacgtacaacgtaggctagactacggtcctcccgtcttccgtacgtttcgggaccgggacgggaaccgtaagggtacggaacgaacgttaaccgaaaaccgtaacgttggacggtcgttacggactaacccg

SEQ ID NO: 409142 - DNA, 626 bp, Homo sapiens
  misc_feature: GZ8MTXP02IJR4H.3.82.H05.1.454.CMB.2.raw
  modified_base (258)..(258): a, c, t, g, unknown or other
  modified_base (276)..(276): a, c, t, g, unknown or other
  modified_base (360)..(360): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccataaggagttttggctgagctgggttttccttgttgctatttcaaaaggtgtccagtgtgaggtgcaggtggtggagactggaggaggcttgatccagccgtggggggtcctgagactctcctgtgcagcctntggcttcaccgtcagtancagctacatgcacgtgggtccgccaggcctccgaggggaaggggctgggaggtgggctcgagttatttacatttcaggtaccanatactactcccgacccgtgaacgggcccattaaccatcctaccgagacgtaacgacttacccgaagaaaccgtcgggttagtactacttacaaaattacgaaacctaaaccgtggaacgtacgccggaacgaccgtacggtccgtttaattaccgtgtcgacgaagtacgtagttacggagttcgggggtaccgggccttaccggtacccgtttagggttccttaacgttccgtaacgtccgtccggttacgggggtccggtccgg

SEQ ID NO: 409143 - DNA, 801 bp, Homo sapiens
  misc_feature: GZ8MTXP02IVOOX.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctggcttcaccgtcagtagcagctacatgcacgtcgggtccgccgaggcctccgaggggaaggggcgtgggaggtcgggtctcgtagtttaatttacgaactttcgtacggtaccaactacttaccttaacccgtcccggtaacccccggttaggaaaccggggtacccgtaaacttaaacccgacttacccgtacccgaaggaacgtaaccgtaactttacccggaaagtaaaccgtacggggtttagtaaacttaccgtttaaacaaaaagttacgaaaaacctaaacccgttaggaaacggaccggacccgggaaaccgtaaaccggtaacccggggtttacccgtttttaaaattaccggttagggttacgggaccggtaaaacggtaacggtaacggttttaccggggtaaaggggtttccgggggtttacccgggggtaacccccttaccgtaacccccggttttggggttttaaccctttaaaccgtttccggtacgttccggtttcccggggtcggggggtcccccgtttaccgggg

SEQ ID NO: 409144 - DNA, 546 bp, Homo sapiens
  misc_feature: GZ8MTXP02G2VMG.3.82.H05.1.454.CMB.2.raw
  modified_base (491)..(491): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccgaggggaaggggctgggagtggggtctcagttatttacaattctggtacacatacctactccgacccccgtgaaacgggccgaattaaaccatctcccagagacgattacccgagaacacggtgtatcttacaaatgaaacaacctagaagagacccgaacgaacgacggccgtttatactgtntacgagagattcgaggtgtcggggacctcaaccgtgtctactcgatctcgtcggg

SEQ ID NO: 409145 - DNA, 774 bp, Homo sapiens
  misc_feature: GZ8MTXP02GPCCA.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctcgtggcttcaccgtcagtgcagctacatgctacgtcgggtccgccaggccgtaccgaaggggaacggggctaggggaggttggggttcctacgtaaggtttaacttttaacaaacgtttccgtacggttaacccaactaacttaacccgttaccctccccgggtaaccccccggtagggtaaaccggggcccgtaaactttaaacccgacttccctacccgaagaacgaaccgtaacgttcccgaaagaaaccgtacggggttattaacttactttaacaaaacgtacggaaaacctaaaccgttaggaacgtaccgaccccggaaaccgaaccgtaaccgggttacccgttttaattaaccgtgttaggacggaaggtagtaccgtttagggaacggggtttcgggggttacccgggggtaaacccttcccgtaccccggtttaacggggtttcccttaaccgtttaccgggtaactttcccggttaccgggtttccggggggccctttaccggggg

SEQ ID NO: 409146 - DNA, 538 bp, Homo sapiens
  misc_feature: GZ8MTXP02JN42G.3.82.H05.1.454.CMB.2.raw
  modified_base (381)..(381): a, c, t, g, unknown or other
  modified_base (433)..(433): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgcgactctcctgtgcaatttctgaagccccttccaatacagtgtggatgaattgggtccgccaggctccgaggggaaggggctggagtgggttggccataataaaaagtagactgctggtgagacaacagactacgctgctgccttnagagcagattcaccatcttcagagatagaatcacagagcactcttagtttcngacaaatgaaacacgcctaggaagaccggcggaccacaacggccaattacgtattaacttagtaactaagttaaggacctaatactaacggtccccgtacggggg

SEQ ID NO: 409147 - DNA, 681 bp, Homo sapiens
  misc_feature: GZ8MTXP02HCR89.3.82.H05.1.454.CMB.2.raw
  modified_base (273)..(273): a, c, t, g, unknown or other
  modified_base (302)..(302): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctggcttcaccgtnagtagcagctacatgccacgtgggtcccncgaggcctccgaggggaaggggctgggacgtggggtctcgtagttacctttactaattcgtacggtaacctacgattaccgtaccgtcccgacccccgtgaaaccgggtccgaattaacccgatcctacccgagaacgacgtacgttacccgaagaacgtacgggttatactacttaacaaaattcgaaaacctaaccgtgaacggaacgcccgaaacggacgtaaccgggttacccgttttaaagttaaccgtggtacggtaaccggaagtaacgggtaattttccgggaaagggtttccggggttacccgggggaacccttccgtaacccgttcgggttaccttaacggtcccggtattcccggtcggttccggggg

SEQ ID NO: 409148 - DNA, 594 bp, Homo sapiens
  misc_feature: GZ8MTXP02I4BY2.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagactggaggaggcttgatccagccgtggggggtccctgagactctcctgtgcagcctctggcttcaccgtcagtagcagctacatgcacgtggtccgccaggcctccgaggggaaggggctgggagtgggtctctagttatttacaattctggtaccacatacctactccgacccgtggaacggccgattaaccatctaccagagacgatccgaagaacacggtgtatctacaaatgaaacacctgagacgaccgaacgaccgacggtcgtttattactgtagacgagagtagttacggaggttcgggttaccggggaccctaccgtacccccgtttagggtttaaccttaaccgtttcgtaacgttcgttccgggtcgggggtacccgttccggg

SEQ ID NO: 409149 - DNA, 601 bp, Homo sapiens
  misc_feature: GZ8MTXP02GLMR2.3.82.H05.1.454.CMB.2.raw
  modified_base (433)..(433): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgaggggaagggctgggagtgggtctcgtagttattacaattctggtaccatactactactcccgacccgtggaacggccgaattaaccatcctaccagaacgacgacttccggaagtaacgcgggttntactcttacaaatcgaaaccaaccgtgaacgacgaccggaacgaccgtacgggtcctttaataccgtggtcgacgaagtagtacgttcggaggttcgggttaccgggaccctaccgtaccgttggttaacctacgttcggtacttccgtcggtcggggtacccgtcgg

SEQ ID NO: 409150 - DNA, 564 bp, Homo sapiens
  misc_feature: GZ8MTXP02IISRR.3.82.H05.1.454.CMB.2.raw
  modified_base (403)..(403): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcacgtgggtcccgccaggctccgaggggaaggggctgggaggtggggtctcgtagtttatttacattctggtaccacatactactccgaccccgtagaacgggcgaattaaccatcnccagagacgaattccgagaacacggtagtactcttacaaaatcgaaacaacctgaagacgaccgacgacacggtactttatactgtgacgagacgattcggagttcgggtaccggggactccgtaaccgttggttactacgttcgtacttcgtcgtcgggg

SEQ ID NO: 409151 - DNA, 561 bp, Homo sapiens
  misc_feature: GZ8MTXP02G6LED.3.82.H05.1.454.CMB.2.raw
  modified_base (283)..(283): a, c, t, g, unknown or other
  modified_base (359)..(359): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgtacttggtcgggcgtactcgtacggttttaacagtattggttagtctggtatcagacaagaaaccgagggaaacncccctagacgttcctgatgtctgctgcactcccacctgaccaaaggtcggaacgtcccatccagtattcgagcgtnagttgacgtcgtaggggacagtacgttcacttctacaccatcagcagtcctgcagccgtagaagttatttgacctaaacttactattcgtacaacgtaggctagactcgtacctcccgtcttaccgtacggtttcgggacgggaacggaaccgagggtacggaagtacgtaacgaaacggtagtcggtacgctacgctaacc

SEQ ID NO: 409152 - DNA, 744 bp, Homo sapiens
  misc_feature: GZ8MTXP02GQJYR.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtgggaggaggcttgatccaggccgtgggggtccctgagactctcctgtgcagcctctggcttcaccgtcagtagcagctacatgcacgtcgggtccgccgaggctaccgaggggaaggggctgggaggtgggtctacgtagttactttacgaacttcgtacggtacccacacttaccttaccgtcccggaacccccgtggaaaccgggtccgtaacttaacccgattccgtacccagacgaacgtaacttacccggaaagtaaaccgaccggttagtaacttaccttacaaaacttacggaaaacctaaacccgtaggaacgaacggaccccggaaacggaacccgaaccgggtttaccgtttaagttaacccgttggttacggaccggtaacggtaaggtaacgtttcggggtaaacgggtttccgggggttacccgggggtaaaccccttccggttaacccccgttttacggggttaacccttaacgtttacccggtaacgttccggtttaccgggtcgggggtacccggttccccggg

SEQ ID NO: 409153 - DNA, 649 bp, Homo sapiens
  misc_feature: GZ8MTXP02GW8IR.3.82.H05.1.454.CMB.2.raw
  modified_base (257)..(257): a, c, t, g, unknown or other
  modified_base (625)..(625): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttacaaaaggtgtccagtgtgaggtgcaggtggtggagacgtggaggaggcttgatccagccgtgggggtcctgagactctctgtgcagcctcnggcttcaccgtcagtagcagctacatgcacgtcgggtccgccgaggcctaccgaagggggaacggggcgtggggaggtggggtctacgtaagtttactttacaactttccgtagtaaccactactacctaccgtccccggaccccgtaggaaaccggggtccctaaacttaaccgatcctacccgaggtaacgaacgtacttacccggaagaaaccgtcggggttattaacttccttaacaaaattacggaaaccaaaccgtgacgagcccggaaagaccacgggttcctttaatacgtgtagcgaagtagtcgtaggtacggtcggggttacgggaccctccgtaccgttggttccttaacgtccgngttcctcggcgggggtccctcggg

SEQ ID NO: 409154 - DNA, 721 bp, Homo sapiens
  misc_feature: GZ8MTXP02IAVC9.3.82.H05.1.454.CMB.2.raw
  modified_base (258)..(258): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagattgggaggaggcttgatccagccgtgggggtccctgagactctcctgtgcagcctcnggccttcaccgtcagtagcagctacatgcacgtcgggtcccgccgaggcctaccggaggggaacggggcgtgggaggttggggtctacgtaagtttactttacaactttcgtacggttaccactacttaacctaccgtccccgtaacccccggttaggaaaccggggtacccgtaaactttaaaccccagtttcccacccaaaggaaacgtacccgtaacgttaccccggaaagtaaaaccgtaccggggttattaacttacccttaacgtaaaaattacggaaaacctaacccgttaggaaacggaacgaccccgggaaacgtaaccgtaaccggggttccttttaaagttcgtaggtacggacgaagtaggtacgtttacgggagtttaccgggggttccgggaacccttccgtaaccttcggttaacttaccgtcgtactcggttcgcggggtacctcgg

SEQ ID NO: 409155 - DNA, 631 bp, Homo sapiens
  misc_feature: GZ8MTXP02GUZGP.3.82.H05.1.454.CMB.2.raw
  modified_base (275)..(275): a, c, t, g, unknown or other
  modified_base (453)..(453): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtancagctacatgcacgtcgggtccgccaggctaccgaggggaaggggctgggagtgggtctcgtagttaatttacaattccgtaggtaaccactactacctacctcccggaccccgtaggaaacgggccgtaattaaaccatcctaccagaacgacgagttaccgaagaaaccacgggtntaacttcttacaaaattacgaaacctaaacctggaacgacgacccggaacgaaccgtacggtacccgtttaataccgtgtacgacgaagtagtacttcggacgttcggggttaccgggaccttccgaacccgtttggttaaccttacgtcgtactccgtcggtacgggggcctacggg

SEQ ID NO: 409156 - DNA, 619 bp, Homo sapiens
  misc_feature: GZ8MTXP02IEBE9.3.82.H05.1.454.CMB.2.raw
  modified_base (412)..(412): a, c, t, g, unknown or other
  modified_base (461)..(461): a, c, t, g, unknown or other
  modified_base (481)..(481): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtgggagggaggcttgatccaggccgtgggggtccctgagactctcctgtgcagcctcgtggccttcaccgtcagtgcagctacatgcacgtcgggtcccgccaggcctaccggaggggaaggggctgggaggtgggtctcgtagtttattacactttctacgtaccactatacctacctcccgacccgtagacgggcctactaaccntccaccagacgacacgttaccgaagtaacgtcgggttatactaccttanaaactacgaaacctaaccgngaacgacgaccgaacgaaccgtacggttaccttttagtacgtgtagacgtaagtagtagttcggaagtttcggggtccgggtaacctccgtacccgttggttcctacgttcgacttcgtccggtcggggtaccctcgg

SEQ ID NO: 409157 - DNA, 592 bp, Homo sapiens
  misc_feature: GZ8MTXP02HNQST.3.82.H05.1.454.CMB.2.raw
  modified_base (235)..(235): a, c, t, g, unknown or other
  modified_base (249)..(249): a, c, t, g, unknown or other
  modified_base (251)..(251): a, c, t, g, unknown or other
  modified_base (264)..(264): a, c, t, g, unknown or other
  modified_base (266)..(266): a, c, t, g, unknown or other
  modified_base (270)..(270): a, c, t, g, unknown or other
  modified_base (272)..(273): a, c, t, g, unknown or other
  modified_base (276)..(276): a, c, t, g, unknown or other
  modified_base (278)..(278): a, c, t, g, unknown or other
  modified_base (288)..(288): a, c, t, g, unknown or other
  modified_base (310)..(310): a, c, t, g, unknown or other
  modified_base (411)..(411): a, c, t, g, unknown or other
  modified_base (434)..(434): a, c, t, g, unknown or other
  modified_base (484)..(484): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtcccngacgctctctgtcncncgcctgcgtctcncncagncnncantnctgtcggccncgcgcacggaggggacgggcgngggtggtggtctagtagtttatactacttcgtacgtacactatacctctcccgaccgtaggacggactaactaacatccacgaagacgactacgtacgaanacgtcggtatacttacctaaaanaagacaacctagagacgaccgaccgacgtacgtaccgtttattacgtcgnggacgagagtacgtacggtcgggtacgggttccggggtacccgtacctaccgttcggttacgttaaccttacggtcgtacgtccggtcgggggtaccggttccgtccg

SEQ ID NO: 409158 - DNA, 573 bp, Homo sapiens
  misc_feature: GZ8MTXP02I7GAV.3.82.H05.1.454.CMB.2.raw
  modified_base (360)..(360): a, c, t, g, unknown or other
  modified_base (400)..(400): a, c, t, g, unknown or other
  modified_base (423)..(423): a, c, t, g, unknown or other
  modified_base (428)..(428): a, c, t, g, unknown or other
  modified_base (454)..(454): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggcctccgaggggaggggctgggagtgggtctcgtagttatttacaactttcgtggtaccanatactactcccgaacccgtgaacgggccaattaaccatcnccagacgacgattccgaagaacncggtntatcttacaaatgaaacaacctgganacgccgacaacgcggtcctttatactgtagcgagacgatttcggacgttcgggttaccgggaccttaccgacccgtttgggtccttacgttcggacttccgtcggtcgggggccgtcgg

SEQ ID NO: 409159 - DNA, 664 bp, Homo sapiens
  misc_feature: GZ8MTXP02JD1ZI.3.82.H05.1.454.CMB.2.raw
  modified_base (486)..(486): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagactggaggaggcttgatccagccgtgggggtcctgagactctcctgtgcagcctcgtggcttcaccgtcagtagcagctacatgcacgtcgggtccgccgaggctaccgaggggaaggggcgtgggaggtggggtctcgtaggtttatttaacaatttcgtaggtacccactacttaacctacgtccccggaccccgtaggaaacggggaccctaactttaaacccacgttcctacccgaaggtacgaaaccgtactttacccggaagaaaaccgtaccgggggttnttaacttccttaaaccaaaagttacggaaaactaacccgtagaacggacgacccgaaaccgtacgaccggttaccttttatacgtggtcgacgaagtagtatttcgggagttcgggggttacccggaccttccgacccgttggttccttacgtcgtactcgtcggtcgggggcctcgg

SEQ ID NO: 409160 - DNA, 587 bp, Homo sapiens
  misc_feature: GZ8MTXP02HCMQD.3.82.H05.1.454.CMB.2.raw
  modified_base (435)..(435): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccagccgtgggggtccctgagactctcctgtgcagcctctggcttcaccgtcagtgcagctacatgcacgtcggggtcccgccgaggcctccgaggggaaggggctgggaggtgggtctcgtagttatttacaattctagtacactatactactccgacccgtgaacggccgaattaaccatctaccagacgacgattaccgaagaaccacgggtntaactcttacaaatagaaacaacctgagacgacgaacgacgtacgtaccgtttaatactgtagacgaagtacgagtttcggaagttcggggttacggggccctacgtacccttggtaaccctagttccgtatcgtccggtggggtccctcgg

SEQ ID NO: 409161 - DNA, 664 bp, Homo sapiens
  misc_feature: GZ8MTXP02JY3UC.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggctctaccgtcagtagcagctacatgcacgtcgggtcccgccgaggctccggaggggaaggggctgggaggtggggtctcgtagtttacttacaattctacggtaccacatacctacctcccgaccccgtagaacgggcccgtaattaacccatcctaccagacgacgtacgttaccgagaaccgtacgggttgtaacttccttaacaaattacgaaaacctacccgtagacggaacgaccgaaccgaccgtacgggttacccgtttaagttaaccgtggtacggacggaaggtaggtacgtttacgggacgggtttacggggttacccgggggtaacccttccgtaacccccggttgggtttacccttaacggttccgtacgttccgttcgggtccgggggg

SEQ ID NO: 409162 - DNA, 549 bp, Homo sapiens
  misc_feature: GZ8MTXP02FN8D8.3.82.H05.1.454.CMB.2.raw
  modified_base (425)..(425): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccgaggggaaggggctgggagtgggtctcgtagttatttacaattctggtaccacatcactccgaccccgtgaacggccgaattaaccatctccagagacgattacccgagaacacggtntatcttacaaaatgaaacaacctgaagagaccgacgacacgggtcctttatacctgtgacgagagattcgagtcgggttacggggacctcgaacccgtggttactacttcgatcgtcgtcgggg

SEQ ID NO: 409163 - DNA, 548 bp, Homo sapiens
  misc_feature: GZ8MTXP02G9IR9.3.82.H05.1.454.CMB.2.raw
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagtatggttagtctggtatcagcaagaaaccaggaaacgcccctgacgttcctgatgtctgctgcactcccacctgacaaagtcggacgtccactccagacttcagcgtcagtgaactcgtaggggaacaggtagttccacttctaccaccatacacgcacgcctgacacgacctagtaagtatttacgactaactttacttattacgtactaacgaggtactagactacgtcctacccgctactacgtttacgggacggtacggaccgaggtacggaagtaacgtacgaaacgtacgtgtacggctacg

SEQ ID NO: 409164 - DNA, 650 bp, Homo sapiens
  misc_feature: GZ8MTXP02FTBVS.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtgggaggaggcttggatccaggccgtggggggtccctggagactctcctgtgcagcctctggcttcaccgtcagtagcagctacatgcacgtcgggtccgccacggcctccgaggggaaggggctgggaggtggggttctacgtagtttaactttactaacttctaggtaaccactataacctacctcccggacccgtggaaacgggcccgtaacttaaaccactacctccaagacgtaccgaattccgaagaacgtacggtagtaacttacttacaaattacggaaaccaaccgagacgacccgaacgaccgaaccggtccgtttaattaccgtgtgacgtagatagttacggaggttcggggttaccggggaccttccgtaaccccgttggtttacctaaccgttcgtacgttccgtccggtcgggggtcccgtcggtaccccg

SEQ ID NO: 409165 - DNA, 547 bp, Homo sapiens
  misc_feature: GZ8MTXP02IGSQ0.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactgggaggaggcttgatccagcctggggggtccctgagactctcctgtgcagcctctggcttcaccgtcagtagcagctacatgcactggtccgccaggctccgaggggaaggggctgggagtgggtctcagttatttacaattctgtaccacattaacctactccgaccccgtgaaacgggcccgtaattaaccatctacccagagacgattccgaagaacgacggtgtatcttacaaatgaaacaaacctgagagccgacgacacggcgtttatactgtgcgagagagttcgagttgggtcgggacctctacctggtctacttcgatctcgtcggggccgtcgg

SEQ ID NO: 409166 - DNA, 644 bp, Homo sapiens
  misc_feature: GZ8MTXP02JO5ZE.3.82.H05.1.454.CMB.2.raw
  modified_base (255)..(255): a, c, t, g, unknown or other
  modified_base (548)..(548): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgcaggtggtggagacgtgggaggaggcttgatccagccgtgggggtccctgagactctctgtgcncgcctctggtcttcaccgtcagtagcagctacatcgcacgtcgggtccgccgaggcctaccggaggggaacggggcgtgggtaggtgggtctacgtagtttatttactactttcgtacgtaccactactacctaccgtcccgaccccgtaggaaccgggtacctaacttaaccacttccaccgaagaacgacgtacgttacccgaaagtaaccgtacggttataacttcttaacaaaagtacgaaacctaccgtagacgacgaccgaacaccgtacggttacctttaatacgngtgacgaagtagtagttcggaggttccgggtaccggtaccctccgtacccgtttgttaacctacgttcgacgttccgtcggtcgggggtcctacgg

SEQ ID NO: 409167 - DNA, 584 bp, Homo sapiens
  misc_feature: GZ8MTXP02HW919.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtcctgagactctcctgtgcagcctctggcttcaccgtcagtagcagctacatgcactgggtccgccaggcctccgaggggaaggggctgggagtgggtctcgtagttattacaactttcgtaggtaccactatacctactcccgaccccgtagaacgggcccgaattaacccatccaccaagacgacgacttccgaagaacacggttgtactcttacaaatgaaacaacctgagacgccgaacgacacggtactttatactgtgacgagagtagttcgacggttcgggttaccgggaccctccgtacccgttggttccttacgttcgtacttccgtcggtcggggtcccgtcgg

SEQ ID NO: 409168 - DNA, 535 bp, Homo sapiens
  misc_feature: GZ8MTXP02ISAEW.3.82.H05.1.454.CMB.2.raw
  modified_base (420)..(420): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactgggaggaggcttgatccagccgtggggggtcctgagactctcctgtgcagcctctggcttcaccgtcagtagcagctacatgcactgggtccgccaggcctccgaggggaaggggctgggaggtggggtctcagttatttactaattctgtaccacatactactccgacccgtgaacggccataaccatctcagagacgattccgaagacacggtntatctacaaatgaaacaactagagacgcgacgacacggtccgtttatactgtagcgagagattcggagtggtcgggacctcaccttggtctacgttcgactctcgtcgggcgtcg

SEQ ID NO: 409169 - DNA, 545 bp, Homo sapiens
  misc_feature: GZ8MTXP02HWCR2.3.82.H05.1.454.CMB.2.raw
  modified_base (391)..(391): a, c, t, g, unknown or other
  modified_base (413)..(413): a, c, t, g, unknown or other
  modified_base (418)..(418): a, c, t, g, unknown or other
  modified_base (426)..(426): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccgcaggctccgagggaaggggctgggagtgggtctcgtagttatttacaattctaggtacactatacctactcccgacccgtgaacggccgattaaccntctccagagacgatcgagaacncggtntatcttanaaatcgaaacactgagacgccgacgacacggctttaatctagtgacgagagtattcggagtgggttcgggacctcacccgtggttcctacgttcgactcgtccggtcggggtccgtcgg

SEQ ID NO: 409170 - DNA, 564 bp, Homo sapiens
  misc_feature: GZ8MTXP02IXJYU.3.82.H05.1.454.CMB.2.raw
  modified_base (295)..(295): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtggtccncaggctccgagggaagggctgggagtggtctctagttattacaattctgtacacatacctactccgacccgtagacggccgattaaccatcctaccagagacgattccgagtaaacgcggtagtatccttacaaatacgaaacactgagacgacgacgacgacggtactttatacgtgtgcgtagagtacgttacggacggttcggttaccggggtacctaccgtacccgttggttctaccgttcgtactcgtcgtcgggggccttcgg

SEQ ID NO: 409171 - DNA, 564 bp, Homo sapiens
  misc_feature: GZ8MTXP02IX68U.3.82.H05.1.454.CMB.2.raw
  modified_base (277)..(277): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgtcggttttaacagatggttagtctggtatcagcagaaaccagggaaacncccctagacgttcctgatgtctgctgcactcccaccctgacaaagtggacgtcccatccagattcagcgtcagtgaatccgtagggacagagttcactctaccacatcagcacgcctgcacgcctagaattagttttcgactaaactttacgttattacgttacaacaggacttacggaactcgttcccctaccccggtcttaccgtaccgtttaccgggacgggtaacggaacccgtaagggtacggaacgtaaacgtaccgaaaacggtacgttcggcggctacg

SEQ ID NO: 409172 - DNA, 571 bp, Homo sapiens
  misc_feature: GZ8MTXP02HNP3H.3.82.H05.1.454.CMB.2.raw
  modified_base (429)..(429): a, c, t, g, unknown or other
  modified_base (433)..(433): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggcctccgaggggaaggggctgggagtgggtctcgtagttattacaatttcgtggtaccacatacctactcccggacccgtaggaacgggccctaattaacccatcctaccagagacgatccgaagaacnggtntatctacaatgaaaccactgagacgaccgaacgacgaccggtcgtttaatactgtcgacgagagtattcggaggttcgggttaccgggacctcgtacccgtggttcctacgttcgactccgtcggtcgggggcctcgg

SEQ ID NO: 409173 - DNA, 567 bp, Homo sapiens
  misc_feature: GZ8MTXP02HSUQJ.3.82.H05.1.454.CMB.2.raw
  modified_base (494)..(494): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgaggggaaggggctgggaggtggggtctcgtaagttatttactaattctaggtaccacatacctactcccgacccgtagaacgggccgtaattaaccatcctaccagtacgacgacttccgaagaacacggtgtactcttacaaatgaaacacctgagacgaccgacgacgacgccgtttaatacgtgngtcgagagtatcgacgtgggttcggggacctccgacccgtggttcctacgttcgactctcgtcggggcgtcgg

SEQ ID NO: 409174 - DNA, 593 bp, Homo sapiens
  misc_feature: GZ8MTXP02GT956.3.82.H05.1.454.CMB.2.raw
  modified_base (419)..(419): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccgccaggctccgaggggaggggctgggagtgggtctcgagttatttacaattctgtaccactatacctactccgacccgtgaaacgggccgaattaaccatcctaccagtagacgattccgagaacnggtgtatcttacaaatagaacaactgagagccgagacacggtcctttaagtacctgcgtacgagaacgtatttacggaacggttcggggttaccgggggacccttccgaaccccggtttgggttaaccttaaccgttttcgaacgttcttccggtcgggggtacccgttcgggg

SEQ ID NO: 409175 - DNA, 745 bp, Homo sapiens
  misc_feature: GZ8MTXP02F60AW.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccgagccgtggggggtccctgagactctcctgtgcagcctcgtggtcttcaccgtcagtgcagctacatgcacgtcgggtccgccgaggcctcccggaagggggaacggggcgtaggggaggtggggttcctacgtaagtttaactttaactaacgtttcgtaggtaacccaactaacttaaccttaacctccccggaacccccgtagggaaaccggggtaccctaacgtttaaaacccacttaccctaacccgaaggaacgtaaccgtaaacttacccggaaagtaaaacccgtaaccgggttagttaactttacctttaaaccgaaaaagttaaccggaaaacctaaaccgttagggaacgaaaccggtacccggaaaaccgaaccgtaccgggttaccgtttttaacttaaccgtggtacgaccggtaagaaggttacgttacggaaggttcgggggttaccggggacccttcccgaacccgttggttaaccttacgttcgacttcgtcggtcgggggccgtcgg

SEQ ID NO: 409176 - DNA, 557 bp, Homo sapiens
  misc_feature: GZ8MTXP02JY1XZ.3.82.H05.1.454.CMB.2.raw
  modified_base (394)..(394): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtggtccgccaggctccgaggggaggggctgggagtgggtctcagttatttacaattctggtaccatatacctactcccgaccccgtgaacggccgattaaccatcnccagagacgattaccgaagaacacggtgtatcttacaaatgaaacaacctgagagccgaacgacaccggtcgttaattacgtgtgacgagacgtattcggaggtgggtaccggggacctcgtaccgttggttctacgttcgattccgtcggtcggggcctcgg

SEQ ID NO: 409177 - DNA, 595 bp, Homo sapiens
  misc_feature: GZ8MTXP02JIZGD.3.82.H05.1.454.CMB.2.raw
  modified_base (399)..(399): a, c, t, g, unknown or other
  modified_base (444)..(444): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccgccaggctccgaggggaaggggctgggagtgggtctcgagttatttacaattcgtaggtaccacatacctactccgaccccgtgaacgggccgaattaaccntctaccagtagacgattacccgaagaaccacggtagtactcttanaaagttacgaaaccaaaccgtgaacgacgaccgaacgacgaccggtaccgtttattacgtgtagacgagacgtatttcggaggttcgggttaccggggaccctacgacccgttggttaacctacgttcgactcgtcgttcgggggcctcgg

SEQ ID NO: 409178 - DNA, 749 bp, Homo sapiens
  misc_feature: GZ8MTXP02JX83F.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctcgtggcttcaccgtcagtagcagctacatgcacgtcgggtcccgccgaggcctaccggaaggggaacggggctggggaggtggggtctacgtaagtttactttaacaacgtttcgtaggtaacccataacttacctacgtccccggaaccccgtaggaaacggggccctaacttaacccataccctacccaggtaacgaccggtaacttacccggaaagaaacccgtaccggggttattaacgttaccttaaaccgaaaagttacggaaaaccctaaacccgttaggaacggaaccggaccccggaaacgaaccgtaacccggggttacccgtttttaaacgtaccgttgggttacggaccggtaaaaggtacggtagtttaccggggaaggggtttcggggttaccgggggtaacccctccggtaacccccggtttggttaacccttaaccgttcggtacgttccgcgggttccgggggacccgttccggg

SEQ ID NO: 409179 - DNA, 569 bp, Homo sapiens
  misc_feature: GZ8MTXP02IB2D5.3.82.H05.1.454.CMB.2.raw
  modified_base (296)..(296): a, c, t, g, unknown or other
  modified_base (359)..(359): a, c, t, g, unknown or other
  modified_base (421)..(421): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccnccgaggcctccgaggggaaggggctgggagtgggtctcgtagttattacaattctagtaccanactactactccgaccccgtgaacgggcctattaaccatctcagacgacgattccgaagaacncggtatatacttacaaatagaaacaacctgaacgacgaccgaacgacgacggtaccttttatacgtgtcgacgaagagtattcggagttcgggtaccgggacctcgtaccctggttcctacgttcgactcgtcggtcggggccgtcgg

SEQ ID NO: 409180 - DNA, 562 bp, Homo sapiens
  misc_feature: GZ8MTXP02F1RSB.3.82.H05.1.454.CMB.2.raw
  modified_base (255)..(255): a, c, t, g, unknown or other
  modified_base (271)..(271): a, c, t, g, unknown or other
  modified_base (274)..(274): a, c, t, g, unknown or other
  modified_base (277)..(277): a, c, t, g, unknown or other
  modified_base (281)..(281): a, c, t, g, unknown or other
  modified_base (307)..(307): a, c, t, g, unknown or other
  modified_base (312)..(312): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcgtggtttcgtgtaggctattcaaaggtgtccagtgtgaggtgcaggtggtggagacgtggaggaggcttgatccaggcctggggggtccctgagactctcctgtgcagcctntggcttcacgtcagtncancantgcngtcggccgcgaggcacggagggaggngtggnggtggtcgtctattattatactctcgtacactactactactccgaccgtacggacgtacgtaactaactactactacgacgacgacgtacgtacgaacgaacgtacgtacgtactactactaacgtaacaacaactacgagacgacgacgacgacgtacgttacgtacgtgtagagagtacgtagtagtcggtcggtacggtacgtaccgtaccgtcgtcgtacgtacgtacgtcgtcgtcggtcggtcg

SEQ ID NO: 409181 - DNA, 686 bp, Homo sapiens
  misc_feature: GZ8MTXP02IPNDQ.3.82.H05.1.454.CMB.2.raw
  modified_base (492)..(492): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggtttcctgtgctattcaaaggtgtccagtgtgaggtgcaggtggtggagactggaggagcttgatccgagccgtgggggtcctgacgactcgtccgtgtcgcagcctcgtggcttcgacgtcagtacgcagtctacgatgctacgtcggccgcgtaggcctacggaggggtaacggctagggtacgtcgggtactacgtagttaacttacgtaaccgttcgtagtaccctacgtacgttaccgttaaccgtccggtaacccgttaggaacggtaccgtaacgttaaccgacgttccaccgaaggtacggaacccgtagttacccggaaggtaaacgtccggggttnttaacgtacccgtttaaacaaacggttcgaaacccgttaaccgttgggaacgtaccgtaccgggtaactaccggtggttaaccctttagtaaccgtgtacgaacgtagtacgtacgttcggacgttcgggtacccggtactccgtacgtttacgggtccttacgtcgacttccggtaggtccggggtacctacg

SEQ ID NO: 409182 - DNA, 558 bp, Homo sapiens
  misc_feature: GZ8MTXP02G3GU9.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcacgtgggtccgccaggctccgaggggaaggggctgggagtggggtctcagttatttacaatttctggtaccatatacctactcccgaccccgtgaacgggccgaattaacccatctccagacgacgattccgaagaaccacgggtgtatcttacaaatcgaaacaaacctgagagacccgaacgacacggtccgtttatacctgtgacgagacgattcgagtcgggttacgggacctcaccgttgtctacttcgactctcgtcggggcctcgg

SEQ ID NO: 409183 - DNA, 600 bp, Homo sapiens
  misc_feature: GZ8MTXP02H8SQH.3.82.H05.1.454.CMB.2.raw
  modified_base (446)..(446): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcgtgggttttccttgttgctatttcaaaaggtgtccagtgtgaggtgcaggtggtggagactgggaggaggcttgatccagccgtggggggtccctgagactctcctgtgcagcctctggcttcaccgtcagtagcagctacatgccagtcgggtccgccaggcctaccgaggggaacggggctgggaggtgggtctacgtagtttattacaattcgtaggtaccactactacctacctccgacccgtagaacgggccaattaaccattccaccagacgacgattacccgagaaacgtcgggtntactcttacaaatacgaaacaccgtagaacgacggaccgacgaccacgggtacctttaatacgtgcgacgaagtaggtattcggagtcgggttaccggggacctcgtaccgtggttaacctacgttacggtactcgtcggtcggggtccctcgg

SEQ ID NO: 409184 - DNA, 550 bp, Homo sapiens
  misc_feature: GZ8MTXP02JXIBH.3.82.H05.1.454.CMB.2.raw
  modified_base (347)..(347): a, c, t, g, unknown or other
  modified_base (392)..(392): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccgaggggaaggggctgggagtgggtctcgagttattacaattcnggtacacatactactcccgacccgtgaacgggccattaaccatcnccagagacgattccgagaacacggtgtactcttacaaatcgaaacaccgtgacgagccgacgacacggacgtttatactgtgcgagagattcggaggtcgggttcggggacctcgacccgttggttcttacgttcgacttctcggtcggggccgtcgg

SEQ ID NO: 409185 - DNA, 573 bp, Homo sapiens
  misc_feature: GZ8MTXP02HFLU8.3.82.H05.1.454.CMB.2.raw
  modified_base (367)..(367): a, c, t, g, unknown or other
  modified_base (408)..(408): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgactatccagatgacccagtctccatcctccgtgtctgcatctggtaggggacagagtcgctatgacttggtcgggcgacgtcggtcggttttgacagtagtggttagtcgtggtatcagcaagaaaccgagggaaacgcccctagacgttcctgatgtctgctgcactcccacctgacaaaggtcggacgtcccccatccagtacttcagcgtcagtnaatcgtagggacagtacgtcactctacacatcagcacgccngcacgacctagtaagttatttacgacttaaacttacttattacgtaacaacgacggactacgactacgttccctccccgtctaccgtaccggttacggggacgggtaacgggaaccgaaaggggtaacggaagtaacgtacgaaaacgtacgtacggtacgaccg

SEQ ID NO: 409186 - DNA, 536 bp, Homo sapiens
  misc_feature: GZ8MTXP02HCPSB.3.82.H05.1.454.CMB.2.raw
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttggtcgggcgactcgcggttttaacagatggttagtctggtatcagcaagaaaccagggaaacgcccctgagttcctgatgtctgctgcactcccacctgacaaaggtgacgtcccatccagattcagcgtcagtgatcgtgggacagagttcactctcacatcagcagcctgcagcctagaagttatttagactaaactttactattgtacaacgaggctaggactacgtcctacccgcttactacgtttcgggacggtacgggaaccaaggggtggaacgtaactaaccgaaaacggtaacgtggtacggacctcggacaaccg

SEQ ID NO: 409187 - DNA, 576 bp, Homo sapiens
  misc_feature: GZ8MTXP02GRRHO.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggcctccgaggggaggggcgtgggagtgggtctcgtagttactttacaatttctaggtaccactatacctacctccgacccgtagaacgggccaattaaccatctaccagagacgacttccgagaacacggtagtatcttacaaatcgaactaacctgaagacgaccgacgacgacggtaccgtttatacgtgtcgacgagagacgttacgaggtcgggttaccggggaccttccgaacccgttggttacctacgttcgacttcgtcggtcgggg

SEQ ID NO: 409188 - DNA, 587 bp, Homo sapiens
  misc_feature: GZ8MTXP02JLW7D.3.82.H05.1.454.CMB.2.raw
  modified_base (440)..(440): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtcccgccaggcctccgaggggaaggggctgggggtggtcgtcgagttagttacctattctggtaccacactactacctccgacccgtcgacggccgacttaaccatacctccagagacgattaccgagacacagtgtatcttanaaatagaacaacctgagacgaccgacgaactacggtacgtttacttaactgtcgtacgaggtagaacgttccggaaggttcggggttaccggggtacctaccgtaacccgtcggtttacctacttcggtactccgtcgttccggggg

SEQ ID NO: 409189 - DNA, 555 bp, Homo sapiens
  misc_feature: GZ8MTXP02I00AK.3.82.H05.1.454.CMB.2.raw
  modified_base (236)..(236): a, c, t, g, unknown or other
  modified_base (345)..(345): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttggtcgggcgactcgcggttttaacngatggttagtctggtatcagcaagaaaccagggaaacgcccctagagttcctgatgtctgctgcatccacctgacaaagtcggactcccatccagattcagcgtcagtnatcgtgggacagtacgttcactctacaccatcagcagcctgacacgctagaacgtattttcgactaaactttattattcgtacaacgaggacttgaactacgttccctacccgtccttaccgtaacggtttccggggacggggtacgggtaacccgaggggtaggaacgaactaacgaaaacgtaacgtggtacggctacggactaaccg

SEQ ID NO: 409190 - DNA, 553 bp, Homo sapiens
  misc_feature: GZ8MTXP02GPGTP.3.82.H05.1.454.CMB.2.raw
tcagagacgcactccacgaccggtgctcgatttagtcgagctctctcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactgggtccgccaggctccgaggggaaggggctgggagtgggtctcagttatttacaattctgtaccacatactactcccgacccgtgaacgggccattaaccatctaccagagacgattccgaagaacacggtgtaactcttacaaaatgaaacaaacctgaagacgacccgaacgaccacggtaccgtttatacgtgtcgcgaagagatttcgagtgggttccgggacctcacccgttggtctactcgatcgtcgtcggggcctcgg

SEQ ID NO: 409191 - DNA, 596 bp, Homo sapiens
  misc_feature: GZ8MTXP02F1YT6.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccgccgaggcctccgaggggaacggggctagggaggtggggtctcgagtttattacaactttcgtgtaccactatacctacgtcccgacccgtagaacgggacctattaaccatcctacagacgacgacttaccgaagaacacggttgtactctacaaatgaaacactgagacgacgacgacgacggtcctttatacgtgtgacgagtagtagttcggtacggttcgggttacggggtaccttccgtacccgttggttaaccttacgttacggcttcgttcggtccgggggcctttccgggg

SEQ ID NO: 409192 - DNA, 569 bp, Homo sapiens
  misc_feature: GZ8MTXP02FV2C5.3.82.H05.1.454.CMB.2.raw
  modified_base (283)..(283): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttggtcgggcactcggtacggttttaacagtatggttagtctggtatcagcaagaaaccgagggaaacnccccgtagacgttcctgattgtctgctgcactcccaccctgacaaagtgactcccatcccagacttcagtcgtacagtagaatcgtagggactaggtacgttacaactctaccacctatacacgcagcctagccaacgcctagtaaagttattttacgaaccttaaactttactatttacgacaacgaggtactgaactcgtcctacccgcttactacgttcgggacgtacgggaccgaagggtaggaagtaacgtaacgaaaaccggttgtacggtacggcaacg

SEQ ID NO: 409193 - DNA, 641 bp, Homo sapiens
  misc_feature: GZ8MTXP02HB2UM.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagactggaggaggcttgatccagccgtggggggtccctgagactctcctgtgcagcctctggcttcaccgtcagtagcagctacatgcacgtcgggtccgccgaggcctccgaggggaaggggctgggaggtgggtctcgtagtttatttacaacttcgtaggtaccactactacctacctcccggaccccgtaggaacggggccgtaacttaaccatcctaccagacgacgtagttaccgaaagaacgtacgggtagttaacttacttaacaaaagttacgaaaacctaaccgtggaacgtacggacccgaaacgacgtaccgggtacgttttaatacgtgtcgacgagtacgtagtttcgggacggtttcggggtaccgggtacctccgtacccgttggttccttacgttcggtacttccggtcggtcgggggtccgtcgg

SEQ ID NO: 409194 - DNA, 617 bp, Homo sapiens
  misc_feature: GZ8MTXP02FW2B7.3.82.H05.1.454.CMB.2.raw
  modified_base (380)..(380): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtcgggtcccgccgaggcctccggaggggaacggggcgtgggaggtcggggtctacgtagttactttacaattcaggtacacatctacnccgacccgtagaacggcgataaccatctccagacgacgattaccgagtaacgacgtagtactcttaacaaaatgaaaccaaccgtgaacgacgcccgaacgaccgacggttaccgtttaatacgtggtagacggaagtaggtacgtttacggaacggttcggggtttacccggggaccttccgtaaccccgttgggttttccctacgtttacgacgtttcccggtcggttccggggg

SEQ ID NO: 409195 - DNA, 557 bp, Homo sapiens
  misc_feature: GZ8MTXP02JN2V4.3.82.H05.1.454.CMB.2.raw
  modified_base (289)..(289): a, c, t, g, unknown or other
  modified_base (345)..(345): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaacgcccctgagttccngatgtctgctgcatcccacctgcaaagtcggacgtccactccagattcagcgtacngtgaaatcgtagggacagacgttcactctacacatcacgcacgctgacagcctagacgtatttcgactaaacttactattgtacaaacgtcggcttaggacctagtcccctaccgtcttacgtaaccgtttccggggacggtaaccggggaaccgaacggggttacggaagtacgttaaccgaaaacggtacgttcggtacggtacgtccgg

SEQ ID NO: 409196 - DNA, 605 bp, Homo sapiens
  misc_feature: GZ8MTXP02JDSR3.3.82.H05.1.454.CMB.2.raw
  modified_base (466)..(466): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctcgtggcttcaccgtcagtagcagctacatgcacgtgggtccgccaggctccgaggggaaggggctgggaggtgggtctcgtagttaatttacaagtttctggtaacccactacttaacctacctcccggaacccccgtagggaaacggggcccgtaattaaacccatcctacccgaagacgaacgtacttacccggaagaacgtacgggtntaacttccttaacaaaagttcgaaacctacctgagacgaccgacgacgaccggtacgtttatacgtgtgacgagacgtgttcggacgttgggtccgggactccgacccttgtctacgtcgtctcgtcgtcggggctcgg

SEQ ID NO: 409197 - DNA, 584 bp, Homo sapiens
  misc_feature: GZ8MTXP02IDVQ6.3.82.H05.1.454.CMB.2.raw
  modified_base (265)..(265): a, c, t, g, unknown or other
  modified_base (369)..(369): a, c, t, g, unknown or other
tcagagacgcactccacgaccggtgctcgatttagtcgagctctctcgcggggggagaggggcccagcactgggattccgaggtgtttccattcggtgatcagcactgaacacagaggactcaccatggagttttggctgagctgggttttccttgttgctatttcaaaaggtgtccagtgtgaggtgcaggtggtggagactgggaggaggcttgatccagccgtgggggtccctgagactctcctgtgcagcctctggcttcnccgtcagtagcagctacatgcacgtgggtcccgccgaggcctaccgaggggaacggggcgtgggagtggggtctcgagtttatttacaattccctaggtaccanactaactaccgtcccgccccgtagaaacgggcccgaatttaacccatctcccaagtacgacgattccgaagaacacggtgtatctacaatgaaacacctagagagccgaagacacggtaccgtttatactgtgacgagtagaacgttcgagtcggttcggggacctcgacccgttggttactaacgttcgactctcgtcggggccgtacggcccg

SEQ ID NO: 409198 - DNA, 626 bp, Homo sapiens
  misc_feature: GZ8MTXP02GTVV7.3.82.H05.1.454.CMB.2.raw
  modified_base (279)..(279): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttggtcgggcgactcgtacggttttaacagtattggttagtctggtatcagcaagaaaccagggaaacncccctagacgttcctgatgtctgctgcactccacctgacaagtcggaactccatccagtactcagctcagtgatcgtagggacagtacttcactctacaccatcacgcacgtcctgaccacgtccgtagaacgttattttacgaacttaactttacttagtttacgtaaccaaacgtacgggtaccttaggaaaccttcggttacccctacccggtccctttaaccggtaacccggtttccgggggaccggggtaaaccggggaaacccggtaaggggttacgggaacggtaaactaaaccggtaaaacggtaacggttcggtacgggaccttacggacctaaaccg

SEQ ID NO: 409199 - DNA, 587 bp, Homo sapiens
  misc_feature: GZ8MTXP02IAEP2.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtgggtccgccaggcctccgaggggaaggggctgggaggtgggtctcgtagttatttacaacttctggtaccacatactactcccgacccgtgaacggggccacttaaccatcctaccagacgacgacttccgaagaacacggtgtatcttacaaatagaaaccaacctagagagccgaacgacacggtccgtttatactgtgacgagagtagttcggaggttcgggttaccggggacccttccgtaacccgttcgggttaacttacgttcgtacttccgtcggtcgggggcccgtcgg

SEQ ID NO: 409200 - DNA, 578 bp, Homo sapiens
  misc_feature: GZ8MTXP02I4QQX.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtcccgccaggcctccggaaggggaacggggctgggaggtggggtctcgtagtttattacaattctaggtaccacatactacctcccgacccgtgaacgggccgtaattaaccatctccagagaccgattcccgagaacgacggtgtactcttacaaatcgaaactacctgagacgaccgacgacacggtcgttattacgtgtcgacgagatagttcggacggttcgggtaccgggaccctcgaacccgttggttacctacgttcgacttcgtcggtccgggg

SEQ ID NO: 409201 - DNA, 585 bp, Homo sapiens
  misc_feature: GZ8MTXP02FNXQY.3.82.H05.1.454.CMB.2.raw
  modified_base (298)..(298): a, c, t, g, unknown or other
  modified_base (436)..(436): a, c, t, g, unknown or other
  modified_base (447)..(447): a, c, t, g, unknown or other
  modified_base (495)..(495): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcgtgggttttccttgttgctatttcaaaaggtgtccagtgtgaggtgcaggtggtggagactggaggaggcttgatccaggccgtggggggtccctgagactctcctgtgcagcctctggcttcaccgtcagtagcagctacatgcactgggtccnccgaggctaccgaggggaaggggctgggagtgggtctctagttatttacaattctggtacactatacctactcccgacccgtaggaacgggccaattaaaccattccaccgagacgtacgacttccgagaaccaggtntatccttaaanaatacgaaacacgagacgacgaccgaacgacgtacgttacttatacgngtagacgtaagacgtagtcggaggtcgggttacccggacctacgtaccgttgttaactacgttacgtactcggtcggtcggggccgtacg

SEQ ID NO: 409202 - DNA, 532 bp, Homo sapiens
  misc_feature: GZ8MTXP02FVZEZ.3.82.H05.1.454.CMB.2.raw
tcagagacgcactccacgaccggtgctcgatttagtcgagctctctcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactgggtccgccaggctccgaggggaaggggctgggagtgggtctcgagttattacaattctgtacacatactactccgacccgtgaacgggccgattaaccatctccagacgacgattccgagaacacggtgtatctacaaatgaaacaacctgagagaccgagacacggtctttatactgtgcgagacgattcggagtcggttcgggacctcgacccttggtctactcgactcgtcgtgggcgtcg

SEQ ID NO: 409203 - DNA, 626 bp, Homo sapiens
  misc_feature: GZ8MTXP02INY8H.3.82.H05.1.454.CMB.2.raw
  modified_base (380)..(380): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctcggttcccaggttccagatgcgacatccagatcgacccagtcctccactccctccgtgtctgctatcgtggtaggggacaggagtcgctatgtacgttggtcgggctacgtcggttacggtttaacagtagttggttagtcgttggtatcgagacaagaaaccgaagggaaaccgcccctagacgtttcctgattgtctgctgcactcccacctgacaaggtggactcccatccgagtacttcgagtcgtcngtagaactcgtaggactaggtacttccactcaccactactcacgcacgtccgtgccgtacgccgtagtaagttctttacgaaccttaactttacgtaacgttcgtaccaacggtacggtactacgtaaccgtcgttacccgtcccgtacttaccgtaccggtttcggggaccggggtacgggtaaccggtaaggggtacggaacgtacgtaaaccgtaaaacggtacgtggtacggtacgtaccgg

SEQ ID NO: 409204 - DNA, 586 bp, Homo sapiens
  misc_feature: GZ8MTXP02FZ3B5.3.82.H05.1.454.CMB.2.raw
  modified_base (401)..(401): a, c, t, g, unknown or other
  modified_base (497)..(497): a, c, t, g, unknown or other
tcagagacgcactccacgaccggtgctcgatttagtcgagctctctcgcgggggggaggaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggagggaggcttgatccagccgtgggggtccctgagactctcctgtgcagcctctggcttcaccgtcagtagcagctacatgcacgtgggtccgcaggctaccgaggggaaggggctgggagtgggtctcgagtttactttacaattctaggtaccacatacctactcccgaccccgtgaacgggccattaaccntctccagagacgataccgaagaaacgcgggttatactacttacaaattacgaacaaacctgaagacgaccgacgaacctcggtaccgtttatacgngtagacgagagtacgttcggagttcgggttaccgggaccttaccgacccttggttcctaacgttcgacttccgtcgtcgggggcctcgg

SEQ ID NO: 409205 - DNA, 632 bp, Homo sapiens
  misc_feature: GZ8MTXP02GZ3I8.3.82.H05.1.454.CMB.2.raw
  modified_base (255)..(255): a, c, t, g, unknown or other
  modified_base (282)..(282): a, c, t, g, unknown or other
  modified_base (421)..(421): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcgtggtttcgtgtaggctattacaaaggtgtcagtgtgaggtgcaggtggtggagactggaggaggcttgatccagccgtggggggtccctgagactctcctgtgcagcctntggcttcaccgtcagtagcagctaacntcgcacgtcggccgccgacggccgtacggaggggagggcgtagggtaggtcggtctacgtagtttaacttactaacgttcgtacgtacactacttacctaccgtcccggtacccgtaggaaccggtacctaactaaccnctacctacgaagacgtactacgtaccgaagtacgtacggtataactactaacaaagtacgaaacctaacgtgacgaccgaccgaacgaccgtacggttactttatacgtggtagacggagtacgtaggtcggtacgggttccgggtaccggaccttaccgtaccgttcgttaacctacgttcgtacgtccggtcggcggggtccgtaacgg

SEQ ID NO: 409206 - DNA, 560 bp, Homo sapiens
  misc_feature: GZ8MTXP02FZPZ4.3.82.H05.1.454.CMB.2.raw
  modified_base (296)..(296): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagtcgtgggggagcctggtcaagccgtgggggtccctgagactctcctgtgcagcctctggattcaccttcagtagctatagcatgaactgggtccnccaggctccgaggggaaggggctgggagtggggtctcgatccattagtagtagtagtagtacatatactacgcagactcgagtgaaagggccattcaccatctaccaagagaacaaccgacaaacgaactacactagtatctagacaaatagaaacagcctagagacgacgagacacggctgtagtattacgtgtagtacgtaggttttggttgggggtcgggaagttacggacggacggaccgggggtaaccgggggtaaccc

SEQ ID NO: 409207 - DNA, 607 bp, Homo sapiens
  misc_feature: GZ8MTXP02FUP85.3.82.H05.1.454.CMB.2.raw
  modified_base (297)..(297): a, c, t, g, unknown or other
  modified_base (345)..(345): a, c, t, g, unknown or other
  modified_base (434)..(434): a, c, t, g, unknown or other
  modified_base (508)..(508): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctggcttcaccgtcagtagcagctacatgcacgtgggtccncaggctccgaggggagggctgggagtgggtctcagttattacaattcngtaccacatacctactcccgacccgtgaacgggccaattaaccatcctaccgagacgacgtaacttcccggaagtaaaccacggggttntaacttcttacaaaattcgaaaccaacctggaacgacgaccccgaagacccacgggttccgttttaattaccgngtacgcgaagagtatttcggaacggttcggggttaccgggaccctccgtaacccgttgggttaacctacgttcgacttcgtcggtacgggggcctcggg

SEQ ID NO: 409208 - DNA, 597 bp, Homo sapiens
  misc_feature: GZ8MTXP02H5NMZ.3.82.H05.1.454.CMB.2.raw
  modified_base (249)..(249): a, c, t, g, unknown or other
  modified_base (452)..(452): a, c, t, g, unknown or other
  modified_base (504)..(504): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtncagcctctggcttcaccgtcagtagcagctacatcgcacgtgggtcccgccaggcctccgaggggaacggggctagggagtgggtctgtagttatttacaacttcgtaggtaccactatacctactcccgacccgtgaaacgggccgtaattaaccatcctaccagacgacgacttaccgaagaaactcgggtatactcttanaaaatacgaaactaacctgaacgacgccgaacgaccgtacggtaccgtttanaccgtggtacacgtagagtgttcggagttcggggttaccggacctcgtaaccctggttaactccgttacgactcgtcggtcggggtacctcgg

SEQ ID NO: 409209 - DNA, 635 bp, Homo sapiens
  misc_feature: GZ8MTXP02I5MT4.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtgggaggaggcttgatccgagccgtggggggtccctgagactctcctgtgcagcctcgtggcttcaccgtcagtagcagctacatcgcacgtcgggtccgccgaggcctaccgaggggaaggggctgggagtgggtctgtagtttattacacttctgtaccactatacctactccgacccgtggaacggtcccgtaattaaccatcctaccagtacgacgtacttcccggaagtaaaccgtcgggtattaacttccttaacaaaagttcgaaaacctaccgtaggaacgacgacccgtaacgaccgtaccggtaccgtttatacgtgtagacgtagagtagttcggacgggttcgggtaccggggacctacggtacccttgggttaaccttacgttcggactccggttcggtacgggggtcccgttacgg

SEQ ID NO: 409210 - DNA, 571 bp, Homo sapiens
  misc_feature: GZ8MTXP02IVICS.3.82.H05.1.454.CMB.2.raw
  modified_base (276)..(276): a, c, t, g, unknown or other
  modified_base (341)..(341): a, c, t, g, unknown or other
  modified_base (345)..(345): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttgtcgggcgactcgtcggttttaacagatggttagtctggtatcagcagaaaccaggaaancccctgacgttcctgatgtctgctgcatccacctgacaaagtgacgtccatccagatcagcgtanagtnaatcgagatagtatcactcacacatacagcacgctagacacgacgtagtaagttatttacgtaacttaaactttacttaattacgtaacaacgtacgtactacgtaactacgtccctacccgtacttaccgtaccggtttacggggaacgggtaacggggtaaaccgtaagggtaacggaaacgtaacgtaaacgtaaaacgtaaacgtacggtacggtacgtacg

SEQ ID NO: 409211 - DNA, 586 bp, Homo sapiens
  misc_feature: GZ8MTXP02JRUOQ.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtggtccgccaggctccgaggggaaggggctgggagtgggtctcgtagttactttacaacttcgtggtaccacactactactccgaccccgtggaacgggccgacttaaccatcctacagacgacgacttaccgagaacacggtgtaactcgttacaaatacgaacaaccgtgagacgccgacgacacgggtacctttatactgtacgcgagacgtattcggaggtcgggttacggggccttaccgtacccgttggttaaccctacgttacgacttccgtcggtcgggggcctaccggg

SEQ ID NO: 409212 - DNA, 620 bp, Homo sapiens
  misc_feature: GZ8MTXP02H6GZV.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtcctgagactctcctgtgcagcctctggcttcaccgtcagtagcagctacatgcacgtcgggtccgccaggcctccggaggggaaggggctgggaggtgggtctacgtagtttaattacaacgtttcgtacggtaccactataccttacgtcccgtaaccccgtggaaacggccgtaattaaccactcctaccaagacgacgtacttaccggaagaaacgtacggtgtaactaccgttacaaaacgtacgaaacaaccgtgaaagacgacccgaacgacgaacggtacctttaattacgtgtgacgaagtagacgttcggaagttcgggtaccgggaccctccgtacccgttggttaacctacgtcgtactcgtcggtcggggtcctcgg

SEQ ID NO: 409213 - DNA, 540 bp, Homo sapiens
  misc_feature: GZ8MTXP02FK71J.3.82.H05.1.454.CMB.2.raw
  modified_base (235)..(235): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtcccngagactctcctgtgcagcctctggcttcaccgtcagtagcagctacatgcacgtgggtccgccaggctccgaggggaaggggctgggagtgggtctcagttatttacaattctgtaccacatacctactcccgaccccgtgaacgggccattaaccatctaccagacgacgattcccgagaacacggtgtatcttacaaatgaaacaacctgagagccgacgaccacggtccgtttatactgtgcgagagattcgagtggttcgggacctcaccctggttcacttcgactcgtcgtcgggccacg

SEQ ID NO: 409214 - DNA, 584 bp, Homo sapiens
  misc_feature: GZ8MTXP02JXIO2.3.82.H05.1.454.CMB.2.raw
  modified_base (248)..(248): a, c, t, g, unknown or other
  modified_base (261)..(261): a, c, t, g, unknown or other
  modified_base (265)..(265): a, c, t, g, unknown or other
  modified_base (268)..(268): a, c, t, g, unknown or other
  modified_base (271)..(272): a, c, t, g, unknown or other
  modified_base (277)..(278): a, c, t, g, unknown or other
  modified_base (282)..(282): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcgtggtttcgtgtagctattacaaaggtgtcagtgtgaggtgcgaggtggtggagacgtggaggaggcttgatccagccgtgggggtccctgagactctctgtgcncgctcgtgtctcncgtnagngcnnctacnncgcncgtcggccgcgacggcgacggagggagggtcgtgggtggtcggtactacgtagtttacttactacgttcgtacgtaaccactactaccgtaccgtcccggtacccggtaagggaaccggtacctaactacctactccgacgaagacgacgtacgtacgaacgtaacgtcgtactactactactaagacaacacgagacgacgacgagacgtacgtacgtacttatacgtgagagagtagtgtcggtaggtcggtccgtcctaccgtcgttcgttactacgtcgtcgtcgtcgggtcggtccg

SEQ ID NO: 409215 - DNA, 558 bp, Homo sapiens
  misc_feature: GZ8MTXP02FUO2J.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcacgtgggtccgccaggctccgaggggaagggctgggagtgggtctcagttatttacaattctggtacacatactactccgaccccgtgaacggccgattaaccatctccagacgacgtacttccgaagaacacggtgtatcttacaaatcgaaacaaccgtgagacgacccggacaccgaccggtacgtttattactgtgcgagagtagttcgacggtgggttcgggaacctcgacccgttggtctacgttcgactcgtcgtcggggccgtcgg

SEQ ID NO: 409216 - DNA, 714 bp, Homo sapiens
  misc_feature: GZ8MTXP02JM6YF.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtggtccgccaggctccgagggagggctgggagtgggtctcgagtttatttacaactttcgtacggtaccacgtactacctacctccccggaacccccggtaggaaaccggggtcccgtaattaaacccgacttcctaacccgaggaacgaaccgtacttacccggaagtaaacctaccgggggttattaacttacctttaacaaaaacgttcggaaaaccctaaacccgttgggaaacggaacggaccccggaaacggtaacccgtaaccggggttaccccgtttttaaagttaacccgtgggttacggaccggaaggtaagtacgtttaccgggaagggttcggggtttaccggggacccttaccggtaccccgtttggttaaccttacgttcggtacttccgtccggtcgggggccgttccggg

SEQ ID NO: 409217 - DNA, 540 bp, Homo sapiens
  misc_feature: GZ8MTXP02FVBA8.3.82.H05.1.454.CMB.2.raw
  modified_base (410)..(410): a, c, t, g, unknown or other
  modified_base (468)..(468): a, c, t, g, unknown or other
  modified_base (479)..(479): a, c, t, g, unknown or other
tcagagacgcactccacgaccggtgctcgatttagtcgagctctctcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactggtccgccaggctccgagggaaggggctgggagtggggtctcagttattacaattctgtaccacatacctactccgacccgtgaacggccgattaaccatctccagacgacgattccgagaacncggtgtatcttacaaatgaaacaacctgagagaccgacgacacggtacctttattacngtgacgagagnttacgaggtggtcgggacctcaccgttggttcctacgttcgactctcgtcggggacgtcgg

SEQ ID NO: 409218 - DNA, 521 bp, Homo sapiens
  misc_feature: GZ8MTXP02FVNKA.3.82.H05.1.454.CMB.2.raw
  modified_base (273)..(273): a, c, t, g, unknown or other
  modified_base (426)..(426): a, c, t, g, unknown or other
  modified_base (438)..(438): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcaagaaaccagggaaacncccctgagttactgatgtctgctgcatccacctgacaaagtcggagtcccatccagattcagcgtcagtgatcgtgggacagtagttcactctcaccatcagcagcctgcagcctagaagtattttgactaacttactattacgtacaaacgnggtactagaacngtcctccccgcttccgtacgtttcgggacggaaggacctaaagggtgaagtactaacgaaacgacgtggtacggctcgacaac

SEQ ID NO: 409219 - DNA, 577 bp, Homo sapiens
  misc_feature: GZ8MTXP02F1QO8.3.82.H05.1.454.CMB.2.raw
  modified_base (421)..(421): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtgggtccgccaggctccgaggggaaggggctgggagtggggtctcagttattacaattctggtaccacatacctactccgaccccgtgaaacgggccaattaaccatctaccagagacgataccgagaacncggtagtatcttacaaatgaaacaactagagacgacgaacaacgacggtacctttatactgtacgcgagacgtagttacggagtcggggttacgggtaccctccgtaacccgttggttaaccttacgtcggtactctacggtcggggtccgtacgg

SEQ ID NO: 409220 - DNA, 609 bp, Homo sapiens
  misc_feature: GZ8MTXP02HCOJ0.3.82.H05.1.454.CMB.2.raw
  modified_base (295)..(295): a, c, t, g, unknown or other
  modified_base (522)..(522): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactgggtccnccaggcctccgaggggaaggggctgggagtgggtctcgtagttatttacaacttcgtggtaccacattacctactccccggaccccgtaggaaacgggccgtaaacttaacccgatccctaccgaagacgaacgtattacccggaagaacacgggtagtatacttacaaaatgaaaccaaactgaagacgaccgaacgacgaacggtacctttataaccgtgtacgngaacgagactttcggaacggttgggtaccggggacctccacccgtttggtaaccttacgtccgattccgtcgtcgggggtcccgtgg

SEQ ID NO: 409221 - DNA, 633 bp, Homo sapiens
  misc_feature: GZ8MTXP02IVXDM.3.82.H05.1.454.CMB.2.raw
  modified_base (537)..(537): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctggccttcaccgtcagtgcagctacatgcacgtcgggtccgccgaggcctccgaggggaaggggctgggaggtgggtctcgtagtttaatttacaacttctacggtaccactataacctactcccgacccgtaggaacgggccgaattaacccactcctacccaagacgaccgtattacccggaagaaacctcggggtattaactccttaacaaaagttcgaaaacctaaaccgtaggacgaacggacccgaacgtacgaccgggttaccgtttatacgngtcgacgaagtacgattcggaggttgggtacccgggacctaccgtacccgttggttaacctacgtttacggactccgtcgggtcggggcctacggg

SEQ ID NO: 409222 - DNA, 600 bp, Homo sapiens
  misc_feature: GZ8MTXP02HPJ4G.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgaggggagggctgggagtggtctctagttattacattctgtacactatacctactcccgacccgtgaacggccctaattaaccatccaccgagacgacgtagttccgaagaaacgacggtgtaactccttaacaaaattcgaaaacctaacctggaacgacgacccgaacgaaccgtacggtcctttaatacgtgtgacgagagtacgttcgaaggttcgggttacgggacccttccgtaacccgttggtttaacctaccgttacgtcttccgttccggtcgggggtcgtccggg

SEQ ID NO: 409223 - DNA, 665 bp, Homo sapiens
  misc_feature: GZ8MTXP02GTP1D.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccgccaggcctaccgaggggaacggggctgggaggtgggtctacgtagtttactttacaactttcgtacggtaacccactaacttaaccttacccgtccccggacccccgttaggaaacggggacccgtaacttaaacccacttccctacccgaaggaacgaaccgtaacttacccggaaagtaaaccgacgggttagttaacttaccttaacgaaaattacggaaaacctaaaccgtaggaacgacggacccggaacgaccgacggtaccgtttaagtacgtgtagacgagtacgtagttacggaggttcgggtcggggacctccgtaccgttgtaacgtacttcgtactccgtcggtcggggcgtcgg

SEQ ID NO: 409224 - DNA, 595 bp, Homo sapiens
  misc_feature: GZ8MTXP02I2RAF.3.82.H05.1.454.CMB.2.raw
  modified_base (346)..(346): a, c, t, g, unknown or other
  modified_base (353)..(353): a, c, t, g, unknown or other
  modified_base (425)..(425): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtggtccgccaggctccgaggggaagggctgggagtgggtctcagttattacattcngtaccanatacactccgacccgtggaacggccgaattaacgatctaccgagacgacgacgttccgaagaacacgggttntactctacaaatacgaaacacctgagacgcgacgacgcggtactttataccgtgtacgacgagtaacgtagtttaccggagggtttcggggttaccggggacccttaccgtaccccgtttgggttaaccctaacgtttcgtacttccgtcggtcgggggtcccgttccgg

SEQ ID NO: 409225 - DNA, 566 bp, Homo sapiens
  misc_feature: GZ8MTXP02FTV03.3.82.H05.1.454.CMB.2.raw
  modified_base (348)..(348): a, c, t, g, unknown or other
  modified_base (428)..(428): a, c, t, g, unknown or other
  modified_base (452)..(452): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactggtccgcaggctccgagggagggctgggagtgggtctcagttattacaattctgtaccanatactactccgacccgtgaaacggccgtaattaaaccatcctaccaagtacgaacgtattaccgaagtaaacacgggttntatctacaaatgaaaccaactganagaccgacgacacggtctttactactgtgcgagagatttcggagttcggggttcgggaccctacgacccgtttggtaaccttacgtcgtacttccgtcgtcgggggtccgtcgg

SEQ ID NO: 409226 - DNA, 736 bp, Homo sapiens
  misc_feature: GZ8MTXP02HNF0X.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctggcttcaccgtcagtagcagctacatgcacgtcgggtccgccgaggcctaccgaggggaagggctgggagtggggtctacgtagtttactttactaacgtttcgtcggtaaccaacgtacttaaccttaaccgtcccccggtaaccccccggttagggaaaaccggggtaccccgtaaacctttaaacccgaacttcccgttacccgaaacgggaacggaaacccgtaacgttaaccccgggaagtaaaaccgtaccgggttagttaactacctttaaccaaaagttacggaaaaccctaaacccgtgaaacgacgacccggaaacgaccaaccggggttaccctttaagttccgtaaggtcgacgtaagtaagacgtttacgggaacggttcggggtttacccgggaccttacccgtaacccgtttgggttaaccttacgttccgtaacgtccgttcggtcgggggttccgtcccgg

SEQ ID NO: 409227 - DNA, 557 bp, Homo sapiens
  misc_feature: GZ8MTXP02I2UKP.3.82.H05.1.454.CMB.2.raw
  modified_base (413)..(413): a, c, t, g, unknown or other
  modified_base (418)..(418): a, c, t, g, unknown or other
  modified_base (425)..(425): a, c, t, g, unknown or other
  modified_base (477)..(477): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccgcaggctccgaggggaaggggctgggagtgggtctcgagttattacaattctgtaccacatacctactccgaccccgtgaacgggccattaaccatctccagagacgattccgaagaacncggtntatctanaaatgaaacactgagacgcgacgacacggtcgtttatactgtagcgagagtnttacggaggttcgggttacggggaccttccgacccgttggttcctaccgttcggtactccgtcggtcgggggtcctcggg

SEQ ID NO: 409228 - DNA, 643 bp, Homo sapiens
  misc_feature: GZ8MTXP02J2C61.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctcgtggcttcaccgtcagtagcagctacatgcacgtcgggtccgccgacggctccgaggggaaggggctgggagttggggtctcgtagtttattacacttctgtaccacatacctactcccgacccgtggaacgggccgtattaaccatcctacccaagacgacgtacttacccgaagtaaccgaccggtagttaacttccttacaaaacttacggaaaacctaaccctagggacggaacgacccgggaacgaacctaccggggttacccgtttaagttaccgtggtacgacggaggtacggtacgttacggagggtttcggggtaccggggacccttccgaccccggtttggtaaccctacgttcgacttcgtcggtcggggcctcgg

SEQ ID NO: 409229 - DNA, 551 bp, Homo sapiens
  misc_feature: GZ8MTXP02H4VKK.3.82.H05.1.454.CMB.2.raw
  modified_base (437)..(437): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcacgtgggtccgccaggctccgaggggaaggggctggagtggggtctcgagttattacaattctggtaccacatctactccgaccccgtgaacgggccgaattaaccatcctccagacgacgattacccgagaacacggtgtactcttanaaattgaaactacctgacgacgaccgacgacacggtaccgtttatactgtacgcgagagtacttcggagtcggtcgggacctcaacccgtgtactactcgacttcgcgtcgggg

SEQ ID NO: 409230 - DNA, 590 bp, Homo sapiens
  misc_feature: GZ8MTXP02H2L4Z.3.82.H05.1.454.CMB.2.raw
  modified_base (327)..(327): a, c, t, g, unknown or other
  modified_base (398)..(398): a, c, t, g, unknown or other
tcagagacgcactccacgaccggtgctcgatttagtcgagctctctcgcggggagtcagacccagtcaggacacagcatggacatgagggtcccccgctcagctcctggggctcctgctgctctggttcccaggttccagatgcgacatccagatgacccagtctccatcctccgtgtctgcatctgtagggacagagtcgctatgacttggtcggcgacgtcgtacggttttaacagtattgggttagtctggtatcgagacaagaaaaccgagggtaaacgcccctagtacgttccagatgtctgctgcactccacctgacaagngacgtccagtccagtatcagcgtacagtgatcgtaggactagtagtcactctccacatcagaccagtccgngcacgcgtagtaacgttactttacgaacttaacttatacgttacgtaactaacgtacgtactacgtacgtacgttcccgtaccgtaccttaccgtaccggttacgggaccgggtaacgggtaaccggtaacgggtacggtaacgtaacgtaaaccgaaacggtaacgtcgggtacgtcgtaaccgacctacg

SEQ ID NO: 409231 - DNA, 587 bp, Homo sapiens
  misc_feature: GZ8MTXP02FX0P0.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgaggggagggctgggagtggggtctcgagtttattacaattctggtaccactatacctacctcccggaccccgtggaacgggacccgtattaaacccatctacccagacgacgattacccgaagaacgacggtgtaactcttacaaattacgaaacaacctgaagacgaccgacgacacggtcctttatactgtagcgagagtagttacggacggttcgggttccggggtacctccgacccgttggtccttacgtcgtacttccgtcgtcgggggccgtcgg

SEQ ID NO: 409232 - DNA, 666 bp, Homo sapiens
  misc_feature: GZ8MTXP02JKMLH.3.82.H05.1.454.CMB.2.raw
  modified_base (261)..(261): a, c, t, g, unknown or other
  modified_base (265)..(265): a, c, t, g, unknown or other
  modified_base (269)..(269): a, c, t, g, unknown or other
  modified_base (276)..(276): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcgctctgcgtcncgcntagncgcacangcactcggtcgccgacggcgcgacgggaggggacgcggaggtggtcgtctacgttagttaacgtactacttcgtaccgtacactactaacctaccgtaccccggtacggtaacggaccggtacttaaccgtaactactacccgaaacgaagaaccgtaacgttaccgaacggaaacgtaaacgggttcgtaattaccgttactaaaaacacggttaaaccaaaccgttggaaggaccgaccggaaccggaactaacgggttaccgtttaactttagtcgagtacggaagtacgtagttcggaggttacggggttccggggtaccctacctacccgtcggtttacgtcccttacggtacttccggtccgttcgggggcccggtcggtcccg

SEQ ID NO: 409233 - DNA, 529 bp, Homo sapiens
  misc_feature: GZ8MTXP02GMK4D.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccgccaggctccaggggaaggggctgggagtgggtctcagttatttacaattctggtaccacatactactccgacccgtgaacgggccattaaccatctccagagacgattccgagaacacggtgtatcttacaaatgaacacctgagagccgacgacacggccgtttatactgtgcgagagatcgagtggttcggggacctcaccctggttctacttcgatctcgtcggggcctcgg

SEQ ID NO: 409234 - DNA, 554 bp, Homo sapiens
  misc_feature: GZ8MTXP02F89XF.3.82.H05.1.454.CMB.2.raw
  modified_base (420)..(420): a, c, t, g, unknown or other
  modified_base (474)..(474): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcacgtgggtccgcaggctccgaggggaaggggctgggagtgggtctcagtttattacaattctgtacacatacctactcccgacccgtgaacggccaattaaccatctaccagacgacgattccgaagacacggtntactctacaatagaaacaactgagacgaccgacgaccgacggtactttagtacngtacgacgagagtagttggaggttcgggtaccgggacctcgacccgttgtctacgttcgactcgtcggtcggggcctcgg

SEQ ID NO: 409235 - DNA, 844 bp, Homo sapiens
  misc_feature: GZ8MTXP02HZZV1.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtcccgccgaggcctaccggaggggaacggggcgtaggggtaggtcgggtctacgtaggtttactttaacgtaatttcgtacggtacctaactacgttacctaaccgtcccggaacccccgtaggaaaccgggtacccgtaaactttaaacccgacttacccgtacccgtaacggtaacgaacccggtaacgtttacccggaaacggttaaaacccgtaacggggtttacgttaaaccgttaccgtttaaaaccgaaaacgttaccggaaaacccgtaaaccgttacgggaaacgggaacccggtaaccccggaaaccgggtaaacccggttacccgggggttaacccgtttttaaacgtttaaccggttacgggtaacgggtaccggtaaaacgggtacggtaaccgttttacggggaacggggttttaccgggggttacccgggggtaaaccccgttacccggttaacccccgggttttacgggtttaccccgtttaaccggtttcccggttaacgtttaccggtttacccggggttacccgggggg

SEQ ID NO: 409236 - DNA, 666 bp, Homo sapiens
  misc_feature: GZ8MTXP02HPNGV.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggattttggctgagctgggttttccttgttgctatttcaaaaggtgtccagtgtgaggtgcaggtggtggagactggaggaggcttgatccagccgtgggggtccctgagactctcctgtgcagcctcgtggcttcaccgtcagtagcagctacatgctacgtcgggtccgccgaggcctaccggaggggaacggggcgtggggtaggtgggtctcgtagtttatttactaacgttcgtaggtaccacgtattaaccctaccgtcccgaaccccgtaggaaacgggtacccgtaacgttaaacccatccctacccgaagaacgtacgtaacgttacccgaaagaaaccgtacgggttagtaacttacctaacgaaaatacggaaaacctaaccgtaggaacgacggacccggaacgaaccgtaccgggttccgtttaaactaccgtggttacgaggaacggtacgtacgtttcggaggttcggggttaccgggacctcgtaccgttgttaacgtctcgactcgtcggtcgggtcgtcgg

SEQ ID NO: 409237 - DNA, 640 bp, Homo sapiens
  misc_feature: GZ8MTXP02F61X5.3.82.H05.1.454.CMB.2.raw
  modified_base (260)..(260): a, c, t, g, unknown or other
  modified_base (300)..(300): a, c, t, g, unknown or other
  modified_base (583)..(583): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctntggcttcatctcagtagctaataaatgcacgtcgggtccnccgaggcctccgaggcgaaggggctgggaggtgggtgctacttattcatatgagtaggaagacagatacgttcgacagtacgtaccggtaggaacgggccctagtaccaacctatccctacccgaaggaacgtaacctaaaacttacccgaaaacggaaaccgtaccggggtacttacccgtacgtacggtaacctaaaggttagaaacgttaccggacccgttaggaacgtaccggtacgaaccgtaccggaaccggtcgtttgttaagttacgtttaccgnggttacggaacggtaggtaaggttcgggggtttacacgtacggtccggttcccgggg

SEQ ID NO: 409238 - DNA, 761 bp, Homo sapiens
  misc_feature: GZ8MTXP02ICCV3.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggctgatccagccgtgggggtccctgagactctcctgtgcagcctctggcttcaccgtcagtagcagctacatgcacgtcgggtccgccaggctaccgaggggaacggggctgggaggtgggtctcgtagtttattactaactttcgtacggtaccacgtactaaccgttacctccccgaaccccgttaggaaacggggtacccgtaaactttaaacccacttacccgtacccaaggaaacgtaacccgtaacgtttacccggaaacgtaaaccgtaacgggggttacttaaacttaccgtttacaaaaacgttcggaaaacccaaacccgttaggaacggaaccggacccgggaaaccgtaaccggaaccggggttacccggtttttaaacgtttaccgtaggttcggaaccgaaaggtaacggtacgttttaccgggaaacgggtttcgggggtttacccgggggtaaaccccttcccgtaaccccgtttgggttaacctttacccgttacggtacttcccggttcggtccgggggttacccgtccgggg

SEQ ID NO: 409239 - DNA, 571 bp, Homo sapiens
  misc_feature: GZ8MTXP02IKJZI.3.82.H05.1.454.CMB.2.raw
  modified_base (299)..(299): a, c, t, g, unknown or other
  modified_base (395)..(395): a, c, t, g, unknown or other
  modified_base (398)..(398): a, c, t, g, unknown or other
  modified_base (416)..(416): a, c, t, g, unknown or other
  modified_base (473)..(473): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccnccgaggctccgaggggaaggggctgggaggtgggtctacgagtttatttacaattctaggtaccacatctactccgacccgtgaacggcataaccntcncagagactatcgagaacncgtagtatctagaaatgaaacacgtgagacgccgaacgacacggtaccttattacgngtcgacgagtaagtcgtttacgaggttcgggtaccggggtacctaccgaacccgtttcggttaccttacgttacgtacgttccgtttcggtccggggg

SEQ ID NO: 409240 - DNA, 639 bp, Homo sapiens
  misc_feature: GZ8MTXP02I8B30.3.82.H05.1.454.CMB.2.raw
  modified_base (288)..(288): a, c, t, g, unknown or other
  modified_base (427)..(427): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatcgacccagtctccatcctccgtgtctgcatctggtaggggacagagtcgctatgacttggtcgggctactcggtacggttttaacagtagtggttagtcgtggtatcagacaacgaaacgagggaaacncccctgtacgttcctgatgtctgctgcactcccacctgacaaagtcgactcccgatccagtactaccgagtccgtactaggtacgtaacgtcggtacgggaactaggtagttacccactctaccaccagtaccagaccncgtaccgtgactacgaccttagggtaaactttcgttttaacgaccttaaaccgtttaacttagtttaccgaactaaacgtacgggtaccttaggaaccttaccggttccctacccggtacttaccggttaccggttaccggggacggggtaaacggtaaccggtagggtagaacgtaacgtaacgtaaaacgtaccgtgtaacggtctaacg

SEQ ID NO: 409241 - DNA, 729 bp, Homo sapiens
  misc_feature: GZ8MTXP02F2WBY.3.82.H05.1.454.CMB.2.raw
  modified_base (461)..(461): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtcctgagactctcctgtgcagcctctggcttcaccgtcagtagcagctacatgcacgtcgggtccgccaggctccgaggggaggggctgggagtgggtctcgtagttatttacaactttctacggtaccactatacctaccgtcccgtaccccgtggaaacggggccctaacgttaaccatcctacccaagtacgaaccgtaacttacccggaagtaaaccgacggggttnttaacgtacctttaacgaaaagttacggaaaacctaaaccgttaggaacgaccggaccccgggaaacgtaacccgaaccgggtttaccccggttttaatttaaccggtcggttacggaccggtaaagtaacggtacgtttaccggggtaaggggtttcggggtttaaccccgggggacccttttacccgaacccccggttttggggtttaaccctttaacgtttccggtaactttcccggttcggtccgggggtaccccggttccggg

SEQ ID NO: 409242 - DNA, 700 bp, Homo sapiens
  misc_feature: GZ8MTXP02I1N5U.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtcctgagactctcctgtgcagcctctggcttcaccgtcagtagcagctacatcgctacgtcgggtccgccgacggcctccggaggggaacggggcgtgggaggtgggtctcgtagtttatttacattcgtagtaccatactacctactcccgacccgtaggaacgggcccgtaattaaccatcctacagaacgacgacttaccgaagaaacgtacggttagtactacttacaaaagttagaaacctaaccgtagaacgacgacccgggaaccgaacccgtacgggttacccgtttaaagtttacccgtaggttacggaccggtaaaggtaacggttagtttaccggggtaagggtttaccgggggttaaccgggggtaccccttacccggtaaccccggtttgggtttaacccgtttacgttaccggtactttccggtttccggggtcgggggtaccccggtttccggg

SEQ ID NO: 409243 - DNA, 606 bp, Homo sapiens
  misc_feature: GZ8MTXP02GP9VI.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccgccaggctccgaggggaaggggctgggagtgggtctcgtagttacttactaattctggtaccactatacctactccgacccgtgaacgggccattaaccatcctcagacgacgactccgaagaacgacggtgtatcttacaaaatcgaaaacaacctagaagacgacccggaacgaaccgaccggttaccgtttaattacgtgtacggcgtaaagacggtacttcggaaggttcggggttccgggacctccgacccggtttcggttaacctacgttcgacttccgtcggtaccgggggtccgtaccggg

SEQ ID NO: 409244 - DNA, 858 bp, Homo sapiens
  misc_feature: GZ8MTXP02H3O53.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtcccgccgaggcctccggaggggaaggggcgtgggaggttgggtctacgtagttatttacaactttcgtacggtaccactaacttaaccttaccgttccccggaacccccggttaggaaacccgggggtacccgtaaactttaaaccccgaacttacccgtacccgaaaggaaccggtaacccggtaaacgtttaccccggaaacggtaaaacccgtaaccggggtttaacgttaacgtttaaccctttaaccgaaaaaagtttaccggtaaaaacccgtaaaaccccgttagggggaaaacggtaacccgggtaaccccggggaaacccgtaaacccggtaacccggggttacccggttttttaaacgtaaacccgtttgggtacggaccggtaaaaggttaacggtaaccggttttaccgggaaaggggtttccgggggttaacccgggggttaaccccttacccggttaacccccggttttggggtttaacccttttaaccggttaccggtaacggtttacccgttcccggggtttaccggggggtaccccggtttccgggg

SEQ ID NO: 409245 - DNA, 604 bp, Homo sapiens
  misc_feature: GZ8MTXP02F1KUH.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtcgggtccgccaggcctccgaggggaacggggctgggagtggggtctacgtagtttactttacaattcgtaggtaccactactacctacctccgacccgtagaacgggccgaacttaaccatcctacagagacgtattaccgagaacacggtgtactcttacaaaatagaaacctaactagacgacgacccgaacgacgtaccgggtctttatacgtgtcgacgagtagtacttacggacggttcgggttaccggggacccttaccgaaccccgtttggttacctacgttcgacttccggtcgttccggggg

SEQ ID NO: 409246 - DNA, 626 bp, Homo sapiens
  misc_feature: GZ8MTXP02IQCHM.3.82.H05.1.454.CMB.2.raw
  modified_base (381)..(381): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatcgcacgtcgggtcccgccgaggcctccggaaggggaaggggctgggaggtgggtctcgtagtttatttactaacttctagtaccactattacctacncccggtacccgtaggaacggccgtaacttaaccattccaccgagacgacgtacttccggaagaacgtacggtattactctacaaagtacgaaaacctaccgtaggaagaccgaccgaaccgacgtaccgggttacctttagtacgtgtacgagacgtagcgttacgggtaggttacggggttccggggaacctccgtacccgtttgttaaccgttacgttcggacttcgtcgttcgggggctcgg

SEQ ID NO: 409247 - DNA, 658 bp, Homo sapiens
  misc_feature: GZ8MTXP02IA3CS.3.82.H05.1.454.CMB.2.raw
tcagagacgcactccacgaccggtgctcgatttagtcgagctctctcgcgggggagtcagacccagtcaggacacagcatggacatgagggtcccccgctcagctcctggggctcctgctgctctggttcccaggttccagatgcgacatccagatgacccagtctccatcctccgtgtctgcatctggtagggacagagtcgctatgactttggcgggcgactcgtacggttttaacagtattggttagtcgtggtatcgagacaaaggaaaacccgaaggggaaaacgcccccgtaggacgtttccctagtatggtccttgccttggccctacttaccccaaccccgttgaaccgtaaaaggtcggaaccgtacccccatacccagtaactttcgacgtccgtacaggttagacgttcgtagggggaacctaggtacgttaccacttcccacctaccgatcaacgccacgccctggacacgaccgttagtaaagttacttttacgaccttaaactttacgttattacgtacgaacgtaggtctacgaaccgtcgtaccctcccgtacttaccgtaccggtttacgggacgggtaaacgggacgtagggacggtacgaacgtaaccgaaacgtaacgtggtacgcgtacgacctacg

SEQ ID NO: 409248 - DNA, 566 bp, Homo sapiens
  misc_feature: GZ8MTXP02GQS6V.3.82.H05.1.454.CMB.2.raw
  modified_base (417)..(417): a, c, t, g, unknown or other
  modified_base (423)..(423): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactcgggtccgccaggcctccgaggggaaggggctgggagtgggtctcgagttatttacaattctgtaccacatacctactccgacccgtgaacgggcctataaccatcctacagagacgattccgagaacncgggtntactcttacaatagaacaactgacgacgaccgacacgacggtcctttaatactgagcgagacgtattcggaacggttcgggttaccgggacctccgaacccgttggttaacctacgtttctacgtctcggtcggggccgtcgg

SEQ ID NO: 409249 - DNA, 546 bp, Homo sapiens
  misc_feature: GZ8MTXP02FRFP6.3.82.H05.1.454.CMB.2.raw
  modified_base (366)..(366): a, c, t, g, unknown or other
  modified_base (428)..(428): a, c, t, g, unknown or other
  modified_base (482)..(482): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcacgtgggtccgccaggctccgaggggaaggggctgggagtgggtctcagttacttacaattctggtacacactctacnccgacccgtgaacggcgataaccatctcccagagacgattccgagaacacggtgtatcttanaaatgaaacacctgaagacgaccgacgacacggtccgtttatactgtgcgaganacgttcgaggttcgggttacggggcctacgaacgtacgtcggttctacgttcgacttcttcggg

SEQ ID NO: 409250 - DNA, 561 bp, Homo sapiens
  misc_feature: GZ8MTXP02GCKRC.3.82.H05.1.454.CMB.2.raw
  modified_base (392)..(392): a, c, t, g, unknown or other
  modified_base (422)..(422): a, c, t, g, unknown or other
  modified_base (445)..(445): a, c, t, g, unknown or other
  modified_base (450)..(450): a, c, t, g, unknown or other
  modified_base (466)..(466): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactgggtccgccaggctccgaggggaaggggctgggagtggggtctcagttattacaattctggtaccacatacctactccgaccccgtgaacgggccgattaaccntctccagtagacgattccgaagacacggtnatctacaaatgaaacactgaganccganaccaggcctttaatcngtgcgtaagacgtagttccggagttcgggtaccggggaccttcgaccccgttggttcctaacgttcgacttccgtcggtcggggcccgtttacgg

SEQ ID NO: 409251 - DNA, 636 bp, Homo sapiens
  misc_feature: GZ8MTXP02HTUO6.3.82.H05.1.454.CMB.2.raw
  modified_base (262)..(262): a, c, t, g, unknown or other
  modified_base (285)..(285): a, c, t, g, unknown or other
  modified_base (302)..(302): a, c, t, g, unknown or other
  modified_base (552)..(552): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgcttatttcaaaaggtgtccagtgtgaggtgcaggtggtggagacgtggaggaggcttgatccgagccgtgggggtccctgagactctcctgtgcagcctcnggcttcaccgtcagtagcagcanatgcacgtcggggtccnccgaggcctaccggaaggggaaggggctgggaggttgggtctctagtttaatttacgtaattcgtacggtaccactatacctactcccgacccgtagaacggcctaacgttaaaccatacctccaaagacgtaacgtacttcccggaaagtaaaccgtcggttattaacgttacttaacctaaaattacggaaacctaaaaccgtgaagaccgaccgaacgaaccgacggtttaccttagtacgtgacgngagagacgttagacggttcggttcgggacctccgtacccgttgtaaccgttcgtacgtcgtacgttccggtggggtccgtccgg

SEQ ID NO: 409252 - DNA, 586 bp, Homo sapiens
  misc_feature: GZ8MTXP02HB43T.3.82.H05.1.454.CMB.2.raw
  modified_base (283)..(283): a, c, t, g, unknown or other
  modified_base (496)..(496): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagactggaggaggcttgatccagccgtgggggtccctgagactctcctgtgcagcctctggcttcaccgtcagtagcagctanatgcacgtcgggtccgccaggctccgaggggaaggggctggagtgggtctcgtagttacttacaattctggtaccacgatacctactccgacccgtagaacggccgataccatctccagagacgtatccgaagaacacgggtatatcttacgaaatgaaaccaccgtgagacgaccgacgacgaccggtccgtttatacgtgacgtcgaaagngtacgttacggacggttcggggtaccggggacccttacggaacccgttgggtttacctacggttaccggtactttccgtcggtccggggg

SEQ ID NO: 409253 - DNA, 584 bp, Homo sapiens
  misc_feature: GZ8MTXP02HW8PW.3.82.H05.1.454.CMB.2.raw
  modified_base (434)..(434): a, c, t, g, unknown or other
  modified_base (442)..(442): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccgcaggcctccgaggggagggctgggagtgggtctcgtagttattacaattcgtacggtaccatatacctactcccgacccgtaggaacgggcctaattaaccatcctaccagacgacgtatcccgaagaacgacggtntatcttanaaatcgaaacacgtgagacgaccgagaccgacggtacctttatacgtcggtgacgaagtacgtacgttcggacgttcggggttaccgggacctcgtacccgttggttaacctacgttcgactccgtcggtcggggtcctcgg

SEQ ID NO: 409254 - DNA, 528 bp, Homo sapiens
  misc_feature: GZ8MTXP02IZHSI.3.82.H05.1.454.CMB.2.raw
  modified_base (278)..(278): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttggtcgggcgactcgcggttttaacagatggttagtctggtatcagcaagaaaccagggaaacncccctgacgttcctgatgtctgctgcactcccaccctgacaaagtggagtccccatccagattcgagccgtcaggtgaaatcgtaggggacaggagttccactctcaccatcagcacgcctgcagcctagaacgttattttacgactaactttatattgtacaacgaggctgactacgtcctccgctcctacgtttcgggacggtacgggaaccgaggtggaagactaacgaaacgatcggtcggactcg

SEQ ID NO: 409255 - DNA, 574 bp, Homo sapiens
  misc_feature: GZ8MTXP02F9PZY.3.82.H05.1.454.CMB.2.raw
  modified_base (421)..(421): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgaggggaaggggctgggagtgggtctcgagtttatttacaacttctggtaccacatacctactcccgacccgtgaacgggccaattaaccatctccagacgacgattccgagaacncggtatatcttacaaatgaaacaacctgagacgccgacgacgacggtccgtttatacgtgtgacgagagtagttcggaggttcgggttacggggaccctcgtacccgttggttaaccttacgttcgacttccgtcggtccgggggtccgtcgg

SEQ ID NO: 409256 - DNA, 595 bp, Homo sapiens
  misc_feature: GZ8MTXP02FSM1W.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcggtccgccaggctccgaggggaaggggctgggagtggggtctctagttactttacaattcgtaggtaccacatactacctccgacccgtagaacgggccgattaaccatcctaccgagacgacgtattaccgagaacgacggtgtaatctttaacaaagtacgaaacctaaccgtagaaggacgtacccgaacgaccacggtcccgtttaatacgtgtacgacgtagagtacgttcggaggtcgggttaccggggaccttccgaaccgttcggttactacgttcgtactcgtcgtccggggg

SEQ ID NO: 409257 - DNA, 683 bp, Homo sapiens
  misc_feature: GZ8MTXP02IXC6Y.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgcaggcctaccggaggggaacggggctgggaggtggtctcgtagttatttactaattcgtacgtaccactataccttactcccggacccgtaggaacgggcctattaaccatctaccagacgacgtacttaccgaagtaacacgggttagtataccttaacaaaacttacggaaaacctaaacccgtaggaaacgaaccggacccggaaaccggaaccgtaacccggggttacccgttttaagttaaccgtgggttacggaccggtaaaggtaggttacgttaccgggtaagggtttcgggggttacccgggggacccttaccgtaacccgttcggtttaaccgttacgttaccgtacgttccgttacgtcgggggtaccctacggg

SEQ ID NO: 409258 - DNA, 703 bp, Homo sapiens
  misc_feature: GZ8MTXP02GFDKN.3.82.H05.1.454.CMB.2.raw
  modified_base (250)..(250): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagactggaggaggcttgatccagccgtgggggtccctgagactctcctgtgcngcctgtggcttccaccgtcagtgcagctacatgcacgtcggtccgccgacggcctaccggaagggggaacggggcgtaggggaggttcggggttctacgtaaggtttactttacgaactttcgtacggtaacccaactactaacccttaccgtcccggtaacccgtaggaaccgggaccgtaacttaaaccattcctacccgaagaaccgaacgtacgttaacccggaagaaaccgtacgggtacttagttacctaacgaaatacgaaaacctaaccgtagaagaccggaccgaaccgaaccgtaccgggttacctttaacgttaacgtcggtacggtacgaagtaggtacgtttacggaacgggtttacggggttaccggggtacccttaccgtaccccgtttgggttaaccttaccgttcgtacgttccttcgggtccgggtccggtccgg

SEQ ID NO: 409259 - DNA, 579 bp, Homo sapiens
  misc_feature: GZ8MTXP02IBFJJ.3.82.H05.1.454.CMB.2.raw
  modified_base (300)..(300): a, c, t, g, unknown or other
  modified_base (361)..(361): a, c, t, g, unknown or other
  modified_base (395)..(395): a, c, t, g, unknown or other
  modified_base (398)..(398): a, c, t, g, unknown or other
  modified_base (415)..(415): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggctcaccgtcagtagcagctacatgcacgtcgggtcccnccaggctccggaaggggaggggctgggagtgggtctcagttacttacaattctggtaccanatctacctccgacccgtgaacggccgattaaccntcncagagacgattaccganaacgagtgtatctacaaatgaaactaacctgacgacgccgaacgacgtacggtacgttttaatacgtagtcgacggaagtagtacgttacggaggttcggggtccgggggtaccttaccgtaacccgttggttaccttacgttcgacgttcgttcggtcggggg

SEQ ID NO: 409260 - DNA, 645 bp, Homo sapiens
  misc_feature: GZ8MTXP02I9YPH.3.82.H05.1.454.CMB.2.raw
  modified_base (271)..(271): a, c, t, g, unknown or other
  modified_base (424)..(424): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggagcttgatccagccgtgggggtccctgagactctcctgtgcacgcctctggccttcaccgtnagtagcagctacatcgcacgtcggtccgccgaggctaccggaggggaaggggctagggaggtgggtctacgtagtttatttacaacgttcgtacgtaccactattacctaccgtcccgacccggtaggaaaccgggtccgtaacttaaacccntcctaccgagtaacgacgtacgttacccggaaagtaaaccgtacgggttattacttacttaacaaaacgttacggaaacctaaccgtggaacgaccgacccggaaccgaaccgtaccgggttaccgttttaataccgtgtacgacgagtacgtgttacggaggtcgggtacgggacctcgcccgttgttaactcgttacgcgtctcggtcggggtctccgg

SEQ ID NO: 409261 - DNA, 714 bp, Homo sapiens
  misc_feature: GZ8MTXP02HR06P.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagctctcctgtgcagcctcgtggcttcaccgtcagtagcagctacatgccacgtcgggtccgccgaggcctaccggaaggggaacggggcgtaggggaggttggggtctcgttaagtttaatttaacctaacgtttcgtacggtaaccctaactaacttaacccttaccgtcccccgggtaacccccggtaggaaaccggggaccccgttaaacgttaaacccacttccctaccgaaggaaccgtaacgtacgttacccggaaagtaaaccgtacgggttagtaacttacttaaaccaaagttacgaaacctaaccgtaggaagacgacccgaacgtacgtaccgggttacctttaataccgtggtacgcgtaagtacgtaacgttccggaagggttcggggttacccgggaccttccgtaccccgtttggttccttaccgttcggtactcggttccggtcgggggtccgtacccgg

SEQ ID NO: 409262 - DNA, 572 bp, Homo sapiens
  misc_feature: GZ8MTXP02JGR5T.3.82.H05.1.454.CMB.2.raw
  modified_base (278)..(278): a, c, t, g, unknown or other
  modified_base (418)..(418): a, c, t, g, unknown or other
  modified_base (423)..(423): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctcggcttccgaccgtcagtancagctacatgcacgtcggccgcaggctccgaggggaaggggctgggagtggtctgtagttattacattctagtaccatactacctactcccggacccgtaggaacgggccattaaccatctacagagacatcgagaaacncggtntactcacaagtacaaactacgtgacgacgaccgaacgaccgtacgggtccttttataacgtgtaggactagacgtagttcggagttcgggtaccggacctccgtacccgttggttccacgtttcgacgttctcggtcggggaccgtcgg

SEQ ID NO: 409263 - DNA, 732 bp, Homo sapiens
  misc_feature: GZ8MTXP02HFIRL.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtcctgagactctcctgtgcagcctctggcttcaccgtcagtagcagctacatgcacgtcgggtccgccgaggcctaccggaaggggaacggggctggggaggttggggtctacgtaagtttatttacaatttccgtaggtaccacaattacctaaccgtcccgtaaccccgttggaaaccgggcccgtaattaaaccattcctacccgagaaacgtaaccgatttacccggaaagtaaaccgtacgggttacgttaacttactttacaaaaattcggaaaaccaaacccgtttaggaacgaaccggaccccggaaaccggtaacccgtaacccggggttaccggtttttaaacttaccggtaggttacggacggaaaggtagtaacgtttcgggaacggttcgggggtttacccggggacccttcccgtaaccccggtttggtttaacctaacccgtttacggacttcccgttaccgggtccggggggtacccgtcccgggg

SEQ ID NO: 409264 - DNA, 501 bp, Homo sapiens
  misc_feature: GZ8MTXP02GGDLC.3.82.H05.1.454.CMB.2.raw
  modified_base (335)..(335): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcaagaaaccagggaaagcccctgagttcctgatgtctgctgcatccacctgcaaagtgatccatccagatcagctcagtnatctagggacagagttcactctacacatcagcagctcgcagctagagtatttagtactaacttaacttattagttacaacagactgacagtctccgtctctacttacggtcggacggacgaacggtagagataacgaaacgaacgtagtaggtacgtacgacaccg

SEQ ID NO: 409265 - DNA, 613 bp, Homo sapiens
  misc_feature: GZ8MTXP02JU8HJ.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcgaccgtcagtagcagctacatcgcacgtcgggtccgccaggcctaccggaggggaaggggcgtgggaggtgggtctcgtagttatttacacttctagtaccacatacctactcccgacccgtggaacgggccgattaaccacgtctacccgagacgacgtacgttaccgaagaactacggtgtaacttcgttacaaaatcgaaacctaaccgtggaacgacgacccgtaacgaccgtaccggtaccgtttaatccgtggtacgacgaaggacgtacgttcggaggttcgggtccgggacctccgtacccgttggttaacctacgtcgtactcgtcggtccggggcgtccgg

SEQ ID NO: 409266 - DNA, 668 bp, Homo sapiens
  misc_feature: GZ8MTXP02JOUFX.3.82.H05.1.454.CMB.2.raw
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgtacttggtcgggcgactcgtacggttttaacagtattgggttagtctggtatcagcaaggaaaaccgagggaaacgccccctaggacgttcctagtatgtctgctgcactcccacctgacaaaggtcgactcccatccagtactcgagcgtcagtagtagtcgtagggactagtacgttcactctacaccactcacgcacgacctcgacacgtaccgtagtaacgttatttacgaaccttaaactttaacttacgtttacgtaaccgtaaacgtacggtacgtacgtaacgtacccggttcccgttaccccggtcccttacccgttaaccgggtttaccgggggaaccggggttaaaccgggggaaaccggtaacgggggttaacggaaaccggtaaacgtaaccggtaaaaccggtaaccggtacgggttttacggacccgttacggaaccgtaacccg

SEQ ID NO: 409267 - DNA, 594 bp, Homo sapiens
  misc_feature: GZ8MTXP02F7GC7.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtggtccgcaggctccgaggggaaggggctgggagtggggtctacgtagtttactttaacaattctaggtaccacacttacctactcccgaaccccggttagaacggggaccgtaacttaaaccatcctaccaagacgacgtattacccgaagaaacgacgttgtaactcttaacaaatacgaaacaacgtgaagacgaccgacgacgacggtccgtttatacgtgtgacgagaagtctacggaggttcgggtacgggacctaccgaacccgttggttactacgttcgactcgttcgtcgggg

SEQ ID NO: 409268 - DNA, 642 bp, Homo sapiens
  misc_feature: GZ8MTXP02GPPEF.3.82.H05.1.454.CMB.2.raw
  modified_base (269)..(269): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtcctgagactctcctgtgcagcctctggcttcaccgtnagtagcagctacatgcacgtcggtccgccgaggctccggaggggaacggggctgggaggtgggtctacgtagtttaatttacaacgtttcgtacggtaaccactaataccttaccgtcccggacccccgtaggaaacgggcccgtaattaaacccatcctacccgaagacgacgtaacttccgaacgaaacgtaccggttataactccttaacaaaagttacgaaaccaaacctaggacgacgacccggaacgaaccgacgggttaccgtttaatacgtcggtagacgtaagagtagttcggaggttcggggttaccgggacctaccgactacgttcggttcctacgttcgactttcgtccggtcggggtccg

SEQ ID NO: 409269 - DNA, 521 bp, Homo sapiens
  misc_feature: GZ8MTXP02HH1PY.3.82.H05.1.454.CMB.2.raw
  modified_base (340)..(340): a, c, t, g, unknown or other
  modified_base (346)..(346): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagattggttagtctggtatcagcaagaaaccagggaaacgcccctgacgttcctgatgtctgctgcatcccacctgcaaagtgacgtccatccagattcgancgtacngtgaatcgtggggacagtagttcactctacaccatcagcacgcctgcacgctagaacgttatttcgactaacttacgtaattcgtacaacgtaggtctagacacgtcctcccgctcgtacgttcggacggtacggaccaaggtgaacgtagtacaaaccgtagtgtacggactcg

SEQ ID NO: 409270 - DNA, 585 bp, Homo sapiens
  misc_feature: GZ8MTXP02HLT1T.3.82.H05.1.454.CMB.2.raw
  modified_base (268)..(268): a, c, t, g, unknown or other
  modified_base (513)..(513): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagactggaggaggcttgatccagccgtgggggtccctgagactctcctgtgcagcctctggcttcaccgtnagtagcagctacatgcacgtgggtccgccaggcctaccgaggggaacggggcgtgggaggtggggtcctcgtagtttatttacaatttccgaggttaccactactaacctacctcccgaccccgtagaacggggcccaattaaaccatcctaccgagaggacgattcccgagaacacggtgtactcttacaaatagaacaaactgagacgccgacacgacggtcctttatacctggtcgacgtanattagtcgaaggttcgggtacgggacctacaccccgttggttcctacgttcattccgtcgtcggggcgtcgg

SEQ ID NO: 409271 - DNA, 595 bp, Homo sapiens
  misc_feature: GZ8MTXP02I6YNQ.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtcgggtccgccaggcctccgaggggaggggctgggagtgggtctcgtagttatttacaatttcgtggtaccactatacctacctccggaccccgtggaaacgggcccgtattaaacccatcctacccgagaacgacgattcccggaagaaacgcggtgtactcttacaaatagaaacactgagacgacgacgaccacggtcctttatactgtacgcgtaagacgtattcggaggttcggggttaccggggaccttacccgaccgttggttaacctacgttcgactcgtcggtcgggggtcctcgg

SEQ ID NO: 409272 - DNA, 697 bp, Homo sapiens
  misc_feature: GZ8MTXP02GNW7I.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtgggaggaggcttgatccagccgtgggggtccctgacgactctcctgtgcagcctctcggtcttcaccgtcagtagcagctacatgcacgtcgggtccgccgaggcctaccggaggggaacggggcgtggggtaggtcggggtctacgtagtttaactttacaactttcgtacgtaccaactacttaacccttaccgtccccggtacccgtaggaaccggggtaccgtaacttaaccactccctaccgaagtacgaccgtaacgttaccggaaacgtaaccgtacggttagtacttaccgttaacaaaacgttacgaaacctaaccgtaggaacgtacggacccgaacgaccgtacggttccgtttaatacgtggtagacgtaaggtacgtacgttcgggtacgggttcggggtaccggggtaccctaccggttacccgtttaggttaaccgttacgttccgtacgttccggtcggtcgggggtccgtccggg

SEQ ID NO: 409273 - DNA, 675 bp, Homo sapiens
  misc_feature: GZ8MTXP02JM6SZ.3.82.H05.1.454.CMB.2.raw
  modified_base (476)..(476): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccgagccgtgggggtccctgagactctcctgtgcagcctcgtggtcttcaccgtcagtagcagctacatgcacgtcgggtccgccgacggctccggaaggggagggtcgtgggaggttgggtctacgtagtttactttactaagttctacggtaccacgtactaccgtacctcccggtaccccgtaggaacgggtccgtaacttaacccatcctacccgagtacgacgtacgttaccgaacgtaacgtacggtntacgttcttaaacaaacgttacgaaactaaccgtagaacggaccgaacccggaacgacgtaaccgggtccgtttaattaccgtgttacgacggtagtaacgtacggttacgggtaacggttcggggttaccgggtaccctacccgtaacccgttcgggtttaccttacggttacgtacgttccgtcggggttcccgggg

SEQ ID NO: 409274 - DNA, 791 bp, Homo sapiens
  misc_feature: GZ8MTXP02GC001.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtgggaggaggcttgatccgagccgtgggggtccctgacgactctcctgtgcagcctctggcttcaccgtcaggtgcagctacagtcgcacgtcgggtccgccgaggcctccggaaggggaacggggcgtggggaggtgggtacctcgtaaggttaactttaacaacgtttccgtacggtaaccctacgtaacttaaccgtaacccgtcccccggtaaccccgttaggaaaccggggtcccgtaaacgtttaaacccgacttcccgtaaccaggtaaccgaacgtacgtttacccggaaagaaaccctacgggggttacttaagtacccttaaacgaaaagttaccggaaaaccttaaccgtaaggacgaaccgacccggaaacgaacccgtacggttacccgtttaagtaaccgtggtacgaccgtaaaggacgtacggtttaccgggaaagggtttccggggttacccgggggtaacccttcccggaacccgggtttttacggttaacccccgtttaaacggtttccgggtaaaccgtttcccgggtttaacccgggtttaccggggggtccggttacccccgggg

SEQ ID NO: 409275 - DNA, 564 bp, Homo sapiens
  misc_feature: GZ8MTXP02J30C6.3.82.H05.1.454.CMB.2.raw
  modified_base (433)..(433): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttcctgttgctatttcaaaaggtgtccagtgtgaggtgcaggtgtggagactggaggaggcttgatccagccgtgggggtccctgagactctcctgtgcagcctctggcttcaccgtcagtagcagctacatgcactcggggtccgccaggcctccgaggggaaggggctgggagtgggtctcagttattacaattctgtaccactatacctactcccgaccccgtgaacggggcctattaacccagtcctccagagacgattcccggaagaacgacgggttntatccttacaaatgaaacaaacctgagacgcccgacgacgacggtccgtttatacgtgtagacgagagtattcgaggtcggttcggggaccctcaccctggttctacttcgactctcgtggggccgtacgg

SEQ ID NO: 409276 - DNA, 572 bp, Homo sapiens
  misc_feature: GZ8MTXP02HV87V.3.82.H05.1.454.CMB.2.raw
  modified_base (172)..(172): a, c, t, g, unknown or other
  modified_base (249)..(249): a, c, t, g, unknown or other
  modified_base (262)..(262): a, c, t, g, unknown or other
  modified_base (273)..(273): a, c, t, g, unknown or other
  modified_base (282)..(282): a, c, t, g, unknown or other
  modified_base (308)..(308): a, c, t, g, unknown or other
  modified_base (313)..(313): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcgtggtttcgtgtaggctattacaaaggtntcagtgtgaggtgcaggtggtggagacgtggaggaggcttgatccagccgtgggggtccctgacgctctcctgtgcncgctctcgtctcncgtcagagcanctacatgcncgtcggcgcgcgcgacggagggaggngtggnggtggtcgtcgtagttattactactctacgtacactactactacctcccgtaccgacggacggtaccgtactactactacacacgagacgtacgtacgacgacgtacgtagtatactactaactacaactaacgtacgagacgaccgacgacgtacgtacgttactacgtgtagagagtacgtagtacggtacggtcggtacggtaccgtaccgtaccgtcgttaacgttacgtacgtacgtcgtcggtcggtcggtcg

SEQ ID NO: 409277 - DNA, 735 bp, Homo sapiens
  misc_feature: GZ8MTXP02G5AYV.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctcgtggcttcaccgtcagtagcagctacatcgcacgtcgggtccgccaggctccgaggggacgggctgggagtgggtctcgtagttatttacaattctaggtaccacatacctacctcccgacccgtggaaacggccgaacttaaccagtcctaccgagacgtaacgtacgttacccggaaggtaaaaccctcgggttaagttaacttaccgttaacaaaaactacggtaaaacccaaacccgttaggaacgaaccggaccccggaaacgtaaaccgtaacccgggttcccttttaaagttaccggtggttaacggaccgggtaaaagtaacggtacgtttcggggaaacgggtttcgggggttacccgggggtaaccccttcccgggtaacccccgtttaggggtttaaccccttaaccggtttacccgggaactttaccgggttcccggggtttcggggggtaccccgtttcccggggg

SEQ ID NO: 409278 - DNA, 546 bp, Homo sapiens
  misc_feature: GZ8MTXP02I5SG6.3.82.H05.1.454.CMB.2.raw
  modified_base (356)..(356): a, c, t, g, unknown or other
  modified_base (417)..(417): a, c, t, g, unknown or other
  modified_base (422)..(422): a, c, t, g, unknown or other
  modified_base (454)..(454): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgcaggctccgaggggaaggggctgggagtgggtctctagttattacaattctaggtaccanatactactcccgacccgtgaacggccattaaccatccaccagacgacgattccgaagaacncggtntatctacaaatgaaacacctgagacgaccganacacgtaccgtttatactgtgcgagacgtattcggagtcgggttcgggaccctcgacccgttggtcctactcgactctcgtcggggcctcgg

SEQ ID NO: 409279 - DNA, 685 bp, Homo sapiens
  misc_feature: GZ8MTXP02HQ81C.3.82.H05.1.454.CMB.2.raw
  modified_base (301)..(301): a, c, t, g, unknown or other
  modified_base (422)..(422): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctggcttcaccgtcagtagcagctacatgcacgtgggtcccnccgaggcctccgaggggaggggctgggagtggggtctcgtagttactttacaatttctagtaccacattacctacctcccgaacccccgtagaaacggggccctaattaaacccattaccncccgaagaacggaccgtaattcccgaagtaaacgtaccggggttatacttacttaacgaaaattcggaaaacctaaccgtaggaacggacgaccccggaaacgaccgtaccgggttaccctttaattaccgtggtacggacggtaaaggtagtaacgtttaccgggaagggtttcgggggttacccgggggacccttaccgtaacccccgggtttgggttaaccctttacccgtcggtactttcccggttccggtccgggggg

SEQ ID NO: 409280 - DNA, 734 bp, Homo sapiens
  misc_feature: GZ8MTXP02ICTDU.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccgagccgtgggggtccctgagactctcctgtgcagcctcgtggcttcgaccgtcagtagcagctacatcgcacgtcgggtccgccgaggcctaccggaggggaggggcgtgggagtcggggtctacgtagtttactttacaatttcgtaggtaccacgtacttacctaccgtacccgtacccccggtagaaaccggggtacccgtaaacttaaacccacttaccgtacccgaaaggtaccggtaaacggtaccgtttacccgggaaacgtaaaccgtaacccggggttagttacttaccttaaacgtaaacgttacgaaaaccgtaaaccgtaggaaacggaccggacccggaaaccgaccgttaaccgggtaccgttttaattaaccgtggtacggtacggtaaggtacgtacgtttacgggaacgggtttccggggtaccggggtaacccctccgtaacccggtttcggttaccttaccgtttcgtaaccttccggttacggtccggggg

SEQ ID NO: 409281 - DNA, 566 bp, Homo sapiens
  misc_feature: GZ8MTXP02JVYSW.3.82.H05.1.454.CMB.2.raw
  modified_base (295)..(295): a, c, t, g, unknown or other
  modified_base (393)..(393): a, c, t, g, unknown or other
  modified_base (402)..(402): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcacgtgggtccnccaggcctccgaggggaaggggctgggagtgggtctcgagtttattacaattctaggtaccactatactactcccgacccgtgaacggccattaaccntcctcaganacgattaccgagaacgtacggtgtactcttacaaattcgaaactaaccgtgaagacgaccgacgacgtaccggtcgtttacttacgtgtacgacgagacgtatcggagttcgggtcgggacctcgtaccgttgtccgtacttcgactcgtcgtcgggccgtcgg

SEQ ID NO: 409282 - DNA, 579 bp, Homo sapiens
  misc_feature: GZ8MTXP02GDIUC.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcggtccgccaggctccgaggggaagggcgtgggagtgggtctcagtttatttacaactttctaggtaccactactaccttacctcccgaccccgtaggaaacggggccgaacttaaccatctaccagacgacgattaccgaagaacacggtgtatcttacaaatcgaaacactgagacgaccggacacgacgacgtttatactgtacgacgagagtagttcggaggttcgggtcggacctccacccgttggttccttacgttcgacttcgtccgtcgggggtacctcgg

SEQ ID NO: 409283 - DNA, 560 bp, Homo sapiens
  misc_feature: GZ8MTXP02HR2CY.3.82.H05.1.454.CMB.2.raw
  modified_base (296)..(296): a, c, t, g, unknown or other
  modified_base (358)..(358): a, c, t, g, unknown or other
  modified_base (427)..(427): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccnccgaggcctccgaggggaaggggctgggagtgggtctctagttattacaattctggtaccanatacctactcccgacccgtgaacggccgtaattaacccatcaccagtagacgattccgagaacacggtntatcttacaaatgaaacacctgagagccgacgacgacgtacgtttatctgtgacgagagtattcggacgttggttaccggggaccttccgaccgttggttcctacgttcgactcgtacgtcggggtccgtcgg

SEQ ID NO: 409284 - DNA, 763 bp, Homo sapiens
  misc_feature: GZ8MTXP02HB41M.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagcttgggttttccttgttgctatttcaaaggtgtccagtgtgaggtgcgaggtggtggagacgtggaggaggcttgatccgagccgtgggggtccctgagactctcctgtgcagcctctggcttcaccgtcagtagcagctacatgcacgtcgggtccgccaggcctaccggaaggggaacgggggtctaggggaggtggggtctacgtagttatttacaacttcgtaggtaccactatacctacctcccggtacccgtagggaaaccggggtacctaacgtttaaacccattacccgtacccaagggaacgtacggtaacgtttacccggaaagtaaaaccgtaccgggttagttaaccttaccgtttaaacaaaacgtttaacggaaaacccctaaaccgttacgggaacggtaaccgggaccccgggaaaccgaaccggtaacccgggttacccgtttttaagttaacccgttgggttacgacggtaaggtaacgttacgttacgggtacggggttacggggttacccgggggtacccttaacccggttcccggtttagggtttccttaaccgtttaccggtacttccggttaccgggtcgggggtcccgttcccgggg

SEQ ID NO: 409285 - DNA, 579 bp, Homo sapiens
  misc_feature: GZ8MTXP02F7KLX.3.82.H05.1.454.CMB.2.raw
  modified_base (471)..(471): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtcccgccgaggcctccgaggggaacggggcgtgggaggtgggtctcgtagttactttacaattcgtaggtaccactatacctacctcccgacccgtgaacgggacgtataacccatcctccagacgacgattaccgagaacacggtagtactctacaaatcgaaacacagagacnccgacgacgacggtctttatacgtgtgacgagagtcgttacggaggttcggtccggggaccttccgaaccgttcggttaccttacgttcgacgttcgtcggtccgggg

SEQ ID NO: 409286 - DNA, 592 bp, Homo sapiens
  misc_feature: GZ8MTXP02GK57G.3.82.H05.1.454.CMB.2.raw
  modified_base (432)..(432): a, c, t, g, unknown or other
  modified_base (504)..(504): a, c, t, g, unknown or other
tcagagacgcactccacgaccggtgctcgatttagtcgagctctctcgcggggggaggaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactcggtccgcaggcctccgaggggaaggggctgggagtgggtctctagttatttacacttctgtaccacattacctactcccgacccgtaggaaacggggccaattaaccactcctaccagaacgacgaagttcccgaaagaacncgggttatactcttaacaaaattagaaaccaacctggaacgacgaccgacgaacaccggtcgtttaatacgngtacgacgagagtattacggagtcggggtacggacctccgaccgtttgggttcctacgtttcgacttcgtcggtcggggtcctacggg

SEQ ID NO: 409287 - DNA, 643 bp, Homo sapiens
  misc_feature: GZ8MTXP02F7UKU.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctggcttcaccgtcagtagcagctacatgcacgtgggccgcacggctccggaggggaggggctgggagtgggtctcgtagtttattacaattctcggtaccactatacctaccgtccccggaaccccgtaggaaacgggtacccgtaacttaaacccatcctaccgaagtaacgacgtaacttacccggaagaaccgacgggttatacttacttaacaaagtacgaaaaccaccgtaggacgacgaccggaacgaacccgtacgggtacctttagtaactggtagacgaaggtagtacgttacgggaggttcggggttaccggggtaccctaccggtacccgttagggttccttaacgttcggacttcgtcggtcggggtccgtcgg

SEQ ID NO: 409288 - DNA, 623 bp, Homo sapiens
  misc_feature: GZ8MTXP02GJXGQ.3.82.H05.1.454.CMB.2.raw
  modified_base (459)..(459): a, c, t, g, unknown or other
  modified_base (528)..(528): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcgtggtttctgtgctattacaaaggtgtcagtgtgaggtgcaggtggtggagactggaggaggcttgatccagccgtgggggtcctgagactctcctgtgcacgctctggcttcaccgtcagtagcagctacatgcacgtggccgcaggctaccgaggggaacggggctgggagtcggggtctacgtagtttacgtttacaactttcgtagtaaccactagttaccttaccgtcccgggtaacccgttaggaaacggggtccctaacttaaaccattaccctaccgaagtaacggacgtattacccgaagtaaccncgggttatactcttacaaatacgaacaactgaaacgcgaccgaacgaccacgggttacttagttaacgnggttcgacgtagtaacgtgtaggtacggttcgggttaccgggacttacccgaccgttggttaactacgtcgtacttcgtcggtcgggccgttcgg

SEQ ID NO: 409289 - DNA, 715 bp, Homo sapiens
  misc_feature: GZ8MTXP02FY7WL.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagacgtggaggaggcttgatccagccgtgggggtccctgagactctcctgtgcacgcctcgtcggtcttcgaccgtcagtagcagctacatcgcacgtcgggtccgccgaggccgtaccggaaggggaacggggcgtgggaggtcggggttctacgtagtttaactttactaacgtttcgtacggtaaccactactaaccttaccgtccccggaccccgtaggaaaccggggtaccctaacttaacccactcctaccgaaggacgaccgtaacgttaccggaagtaaaccgtcgggttagttaacttaccgttaaacgaaaacgttacgaaaccctaaaccgtaggaacgaccgacccggaacgtaaccgtacgggttaccttttagtaccgtggtacgacggtaagacgtacggtttacgggacgggttcggggtcccggggtaacccttccggtaccccgtttggttccttacggttacgtacttccggttcgggtcggggtcccgtttaccggg

SEQ ID NO: 409290 - DNA, 656 bp, Homo sapiens
  misc_feature: GZ8MTXP02F5A50.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctcgtggtcttcaccgtcagtagcagctacatcgcacgtcgggtccgcgaggctccgaggggaggggcgtgggaggtgggtctcgtagtttatttacaacgtttcgtacggtacctactacttaccgttaccgtcccggtaacccccggtaggtaaaccggggttaccgtaaactttaaaccgacttcctacccgaagacgtaacgtaactttaccggaagtaaaccgtacggttacgttaacttacctttaaccaaaagtacgtaaaaccgaacctaggaacgacgacccggaacgaccgtacggtcctttaatacgtgtagcgagacgtagttcggacggttcgggtaccggacctccgtaccgttggtccttacgtctactcgtacggtcgggcgtacgg

SEQ ID NO: 409291 - DNA, 601 bp, Homo sapiens
  misc_feature: GZ8MTXP02HSZHM.3.82.H05.1.454.CMB.2.raw
  modified_base (406)..(406): a, c, t, g, unknown or other
  modified_base (411)..(411): a, c, t, g, unknown or other
  modified_base (442)..(442): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctggcttcaccgtcagtagcagctacatgcacgtgggtccgccaggcctaccgaggggaaggggctgggagtgggtctcgtagttattacaatttcgtacggtaccacattacctactcccgacccgtgaaacggggcctaattaaccnttccnccgaagacgactatccgaagaactacgggtntactcttacaaatagtaaaccactggaagcgaccgaacgacgaccggtcgtttaatacgtgtcgacgagagtcggttacgacggttcgggttaccgggacctccgtacccgttggttaaccttaccttacggacttcgtccggtagggggcccttcggg

SEQ ID NO: 409292 - DNA, 575 bp, Homo sapiens
  misc_feature: GZ8MTXP02F3RGS.3.82.H05.1.454.CMB.2.raw
  modified_base (477)..(477): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcacccgtcagtagcagctacatgcacgtgggccgccaggctccgaggggagggctgggagtgggtctcagttattacattctgtacacatactactccgacccgtgaaacggccaattaaccatctaccagagacgacttccgaagaaacgcgtgtatcgtacaaatagaaacaaacctgagacgaccgaacgaaccgacggtccgtttatacgngtgacgagaacgtgtttacgaggttcgggtacggggtaccctaccgtacccgttggttcctacgttacgtacgttccgtcgtacgggggcccttacgg

SEQ ID NO: 409293 - DNA, 567 bp, Homo sapiens
  misc_feature: GZ8MTXP02GUM63.3.82.H05.1.454.CMB.2.raw
  modified_base (273)..(273): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagtatggttagtctggtatcagcagaaaccagggaaacncccctgacgttcctgatgtctgctgcatccacctgacaagtgacgtccatccagtatcagcgtcagtgatcgtaggacagagttcactctacacatcagcagcctgcacgcctagaagtatttgactaactttactattacgtacaaacgacggtctagaactacggttccctccccggtacttaccgtaccggtttaccgggggacgggtaaccggggaaacccgtaaaggggtcggaacgtaacgtaaccgaaaacggtacgttacggtcggtacttacgggacctaacccg

SEQ ID NO: 409294 - DNA, 661 bp, Homo sapiens
  misc_feature: GZ8MTXP02HS1J8.3.82.H05.1.454.CMB.2.raw
  modified_base (463)..(463): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtggtccgccaggctccgaggggaaggggctgggagtggggtctcgtagttactttacaattcgtaggtaccacatacctacgtcccgacccgtagaacggccgaattaacccatcctaccagacgacgtacttacccggaagaaaccgtacgggtagtacttaccgttaanaaaagttcggaaaacctaaaccgtggaacggaaccgacccggaaacggtaccgaaccggggttaccgttttaacttaaccggtgttacggaccggaaggtaacggtactttaccgggaagggtttccggggttacccggggtaccctccggtaaccccgttggttacctaccgttacgtacgttcgttcggtcggggg

SEQ ID NO: 409295 - DNA, 644 bp, Homo sapiens
  misc_feature: GZ8MTXP02GKP4I.3.82.H05.1.454.CMB.2.raw
  modified_base (424)..(424): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccgccgaggcctccgaggggaaggggctgggagtgggtctctagttattacaattctgtaccacatacctactccgacccgtgaacggccaataaccatctccagacgacgattccgaagaaccacggtntaactcgttaacaaaattacgaaactaaaccgtggaagaccgaccggaaaccgaaccgtacgggttccctttaaagttcgtggtacgacggaagtaagtacgtttacggacgggttcggggttacccggggaaccctccggttaacccccgttgggtttaacccgttaccgtttacggtacttcccggttcgggtaccggggggtccccgtttaccgggg

SEQ ID NO: 409296 - DNA, 669 bp, Homo sapiens
  misc_feature: GZ8MTXP02JF6GR.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtgcagctacatgcacgtgggtccgccaggctaccggaggggaaggggcgtgggaggtggtctcgtagttatttacaacttcgtacgtaccactacttacctacctcccgaccccgtaggaaacggggccctaattaaacccgatcccgtacccaggaacgaccgtaacgttacccggaaagaaaccgtacggggttagttacttaccgttaacgaaaacttcggaaaacctaccgtaggaacgacggacccggaacgaaccgtacccgggttaccgtttttaactacgttggtagacggagaacgtcgtttaccgggaggtttacggggttcccggggaccttccgtacccgtttggttaaccgtacttcgtactccgtcggttcgggggccttcgg

SEQ ID NO: 409297 - DNA, 612 bp, Homo sapiens
  misc_feature: GZ8MTXP02I76OC.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggcctccgaggggaaggggctgggagtgggtctgtagttattacattctggtaaccacatacctactccgacccgtggaacggcctaataaccgatctaccagtaacgacgaattacgaagaaacacggtagtacttacttacaaaatcgaaacctaaccgtgaacgacgaccgtaacgaccgacggtaccgtttaataccgtgtgacgagtaggtacttacgggaggttacgggttaccggggtaccctaccgtaccccgtttgggttaacctacgttacgacttccgttaccggtcgggggtcccgtaccgg

SEQ ID NO: 409298 - DNA, 699 bp, Homo sapiens
  misc_feature: GZ8MTXP02G4ALI.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccgccgaggcctaccggagggggaacggggcgtgggaggtgggtctcgtagttatttacaattcgtagtaccactactacctactcccgacccgtggaaaccgggaccgaattaaaccatcctaccagacgaacgtacttacccggaaagtaaaccgtacgggttattaacttaccgttaaaccgaaaaagttacggaaaaccctaaaacccgttagggaaaccggaaccggaccccgggaaaccggaacccgtaacccggggttaacccgtttttaaagttaccgtggttacggaccggtaaggtaagtacgtttaccgggagggtttcggggttacccggggtacctaccgtacccgttggttaaccctacgttcgacttccgtcggtacggggccgttcgg

SEQ ID NO: 409299 - DNA, 580 bp, Homo sapiens
  misc_feature: GZ8MTXP02JZF45.3.82.H05.1.454.CMB.2.raw
  modified_base (360)..(360): a, c, t, g, unknown or other
tcagagacgcactccacgaccggtgctcgatttagtcgagctctctcgcgggggagtcagacccagtcaggacacagcatggacatgagggtctccgctcagctcctggggctcctgctgctctggttcccaggttccagatgcgacatccagatgacccagtctccatcctccgtgtctgcatctggtaggggacagagtcgctataacttgtcgggcgactcgcggttttaacagtatggttagtctggtatcagcaagaaaccagggaaacgcccctgacgttcctgatgtctgctgcatccacctgacaagtcggagtcccatccagattcagcgtacagtgatcgtagggacagngtcactctacaccatcagcagcctgcacgcctagaacgtattttcgaccttaaactttacttatttacgaactaaacgtagggtactgtaactacgttacccgtcccgaccgttaccgtaaccggtttcggggaccggggtaaacggggaacccgtaaggggtacggaaggtaactaacggaaaaccgtaaacggttggtacggtccgtacgacctaacc

SEQ ID NO: 409300 - DNA, 688 bp, Homo sapiens
  misc_feature: GZ8MTXP02GWQUG.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtgggaggaggcttgatccagccgtgggggtcctgagactctcctgtgcagcctcgtggtcttcaccgtcagtacgcagctacatcgctacgtcgggtccgccgaggcctaccggaaggggaacggggcgtagggaggtgggtctacgtaagtttaactttaactaacgtttcgtacggtaaccaacgtaacttaaccttaccgtccccggtacccccgtaaggggaaacccggggtacctaacgttaaaccctattaccctaaccgaagaacgaccgtaacgttacccgaaagtaaacgtacgggtattaactacttaaacgaaaattacgaaacctaacgtaggaacgacggacccgaacgaaccgtacggttaccgtttatacgtgtacgacgtagtacgtacgttacggacggttcgggttaccggacctccgtaaccgttggttaacctacgttcgtacgtcgtacgtcggggtccgtcg

SEQ ID NO: 409301 - DNA, 614 bp, Homo sapiens
  misc_feature: GZ8MTXP02JN29O.3.82.H05.1.454.CMB.2.raw
  modified_base (425)..(425): a, c, t, g, unknown or other
  modified_base (458)..(458): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccgccgaggcctaccgaggggaacggggctggggaggtggggtcttacgtagtttaactttacaatttccgtaggtaaccactactacctacctcccggacccccgtaggaaccgggtccgaattaacccnttcctaccgagacgacgacttacccgaagaacncgggtatactcttacaaatacgaaacacgtgagacgccgaacgaccgacggtactttatactggcgacgagtagtatcggacggtcgggttaccgggacctcgtacccgttggtttaaccacgtttcgtacttccgtcggtcgggggtccgtccgg

SEQ ID NO: 409302 - DNA, 581 bp, Homo sapiens
  misc_feature: GZ8MTXP02HCWFI.3.82.H05.1.454.CMB.2.raw
  modified_base (300)..(300): a, c, t, g, unknown or other
  modified_base (317)..(317): a, c, t, g, unknown or other
  modified_base (395)..(395): a, c, t, g, unknown or other
  modified_base (496)..(496): a, c, t, g, unknown or other
  modified_base (575)..(575): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatcgtggtaggggacagagtcgctatgtacgttggtcgggctacgttcggtacggttttaaacagtagttggtttaagtcttagggtaatcgaagcaagaaaaccagggaaacnccccctagacgtttccngatgtctgctgcatcccaccctgacaaaagtcggaacgtcccaattcccgaagtacttccgaagtccgttacaggtanaaacgttcgtaggggaacaggtacgtttaccactcctacaccagtcaagcacgtccagcacgtcctagaacgttagtttcaactaacttactatgtaccanggatgaactgtcctccgctactacgttcggacggtacggaaccaagggtacgaagactaacgaaacgtacgtggtacgngtaccg

SEQ ID NO: 409303 - DNA, 641 bp, Homo sapiens
  misc_feature: GZ8MTXP02HZZ96.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagtcttgggttttccttgttgctatttacaaaaggtgtccagtgtgaggtgcgaggtggtggagacgtgggaggaggcttgatccgaggccgtgggggtcctgagactctctgtgcagcctctggtcttcaccgtcagtagcagctacatcgacacgtcgggtcccgccgacggccgtaccggaaggggaaggggtcgtgggtaggttcgggttctacgtaagtttatttactaacttcgtacgtaaccactaacttacctaccgtcccgacccgtagaacggtcctaattaccatccgacagacgtacgtactacgaagaaactcggtataactctaacaaatacgaaacaccgtagaagacgaccgaacgaccgtacggttacttttagacgtgtcgacgaggtaacgttagttccgggaggttccgggggttaccggtacccttccgtacccgttggttaaccctacgtttcgcttcgttcggtcgggggtcctcgg

SEQ ID NO: 409304 - DNA, 714 bp, Homo sapiens
  misc_feature: GZ8MTXP02GXP1B.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctcgtggcttcaccgtcagtagcagctacatgcacgtcggtccgccaggctccggaggggaacggggcgtgggaggtgggtctacgtagttactttacaatttcgtacggtaccaacgtaacttaccgtacctaccccggaacccccggtaggaaaccggggacccgtaaacttaaacccgactcccgtacccaaggaacgaaccgtacttacccggaacgtaaaccgtacgggttagtaaccttactttaaacgaaaacttacggaaaacctaaaccgtacggaacggaaccggacccgaacggtaacccgtaaccgggttaccgttttaacttacgtggtacgtacgtaaggacgtaacgttacggtacgggttcggggttaccgggggtacccttcccgtaacccgtttcgggttaccttaccgttacgtacgttccgttacggttcccggggg

SEQ ID NO: 409305 - DNA, 687 bp, Homo sapiens
  misc_feature: GZ8MTXP02IJ4EX.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgcttatttcaaaaggtgtccagtgtgaggtgcagggtggtggagacgtgggaggaggtcttgactccgacggtccggtggggggtccctggacgtacctcctccgtgtcgcacgcctcgtcggtcttcaccgtcagtagcagctacatgcacgtcgggtcccgaccgacggcctaccggaggggaacggggtcgtagggaggttcgggtctacgtagtttacttaactagtttcgtacggtaccacgtaactaccgtaccgtacccggaaccccggtaggaaccggggtactaaacgttaaccattcaccgagacgacgtaacgttaccggaacgtaaacgtacgggttatacgtacttaaacaaaacgttacgaaaacctaaccgtaggaacgtacgacccgaagaaccgtacggttaccgtttattacgtgtacggacgagtagtacgtttacggacggttcggggtaccggtacctaccgtaaccgtttcggtacttacgtcgtacgttcgtcggtccgggg

SEQ ID NO: 409306 - DNA, 771 bp, Homo sapiens
  misc_feature: GZ8MTXP02IBQJ9.3.82.H05.1.454.CMB.2.raw
  modified_base (274)..(274): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagactgggaggaggcttgatccgaggccgtgggggtcctgacgactctcctgtgcagcctcgtggcttcaccgtnagtagcagctacatcgcacgtcgggtcccgccgaggctaccggaggggaacggggctgggaggtggtctagtagtttattaactacgttcgtagtaaccactacgttacctaccgtcccgtaacccggtaggaaacggggtaccctaaacttaaaccgacttaccgtacccgtaaaggaaacggtaaccgtaacgttaacccggaaacgtaaaccggtacgggttaacgttaacgttaaccttaaacgtaaaacgtaaacgaaaacccgtaaaaccgtacgggaaacgaacggaaccccggaaacccggtaaaccggtaacccgggttaacccgttttaacgtttaaaccggttcggttaacggaccggtaagggtaacgttaacgggtttacgggacggggtttaccggggttaccgggggtacccttaccggtaccccgttcgggttaaccttacgttacgtacgttccggttcggtccggggttccgtcccggg

SEQ ID NO: 409307 - DNA, 603 bp, Homo sapiens
  misc_feature: GZ8MTXP02H50I3.3.82.H05.1.454.CMB.2.raw
  modified_base (427)..(427): a, c, t, g, unknown or other
  modified_base (464)..(464): a, c, t, g, unknown or other
  modified_base (503)..(503): a, c, t, g, unknown or other
  modified_base (524)..(524): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactgggaggagcttgatccagccgtgggggtccctgagactctcctgtgcagcctctggcttcaccgtcagtagcagctacatgcacgtgggtccgcaggcctccgaggggagggctgggagtgggtctgtagttattacaattcgtagtaccacatacctactcccgaccgtgaacggcctaataccatctaccagacgacgtattcccggaaataacgtacggtntaacttaccttacaaaaagttcgaaaccttaaaccgnggaacgacgacccggacgaaccgtaccggtctttttaanacgtgtacgacgtagaacgtnttaccggaggttcggggttacccggactccgtacccgttggttaacctcgttacgattccgtcggtgggggacccctgg

SEQ ID NO: 409308 - DNA, 570 bp, Homo sapiens
  misc_feature: GZ8MTXP02H8A4W.3.82.H05.1.454.CMB.2.raw
  modified_base (434)..(434): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccgccaggctccgaggggaacggggctgggagtggggtctcgtagttactttacaattctggtaccacatacctacctccgacccccgtggaaacgggcctaattaaccatctaccagacgacgatccgaagacacggtntatcttacaaatagaaccaacgtgagacgccgacgacgacggtcctttatacgtgtgacgagacgtattcggaggttcgggttaccgggacctcgacccgttggtcctacgtttcgactcgtcggtcgggccgtcg

SEQ ID NO: 409309 - DNA, 556 bp, Homo sapiens
  misc_feature: GZ8MTXP02FLOAZ.3.82.H05.1.454.CMB.2.raw
  modified_base (419)..(419): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactgggtccgccaggctccgaggggaggggctgggagtgggtctcagttatttacaattctgtaccacatactactccgaccccgtgaacgggccgattaaccatctccagagacgattccgaagaacacggtntatcttacaaatcgaaacaactgagacgaccgacgacacggtcctttatactgtcgcgagagattcggaggtcgggttacggggaccctcgacccgttggttaacctacgtttcgactcgtcgtcgggggccgtcgg

SEQ ID NO: 409310 - DNA, 558 bp, Homo sapiens
  misc_feature: GZ8MTXP02FM40H.3.82.H05.1.454.CMB.2.raw
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttggtcgggcgactcgcggttttaacagtatggttagtctggtatcagcaagaaaccgagggaaacgccccctgagttcctgatgtctgctgcactcccaccctgacaaagtcggacgtccatccagattcagtcgtcagtgaaagtcgtaggggactagtagttcactctccaccatcagcacgcctgcagctagaagtatttcgactaacttactattgtacaacgaggtctagactacgtcctcccgtctaccgtacgtttaccgggacggggaacgggtaaccgtaaggggtaggaacgtaacgttaaaccgaaaacgtaacggttaggtcggtactacgg

SEQ ID NO: 409311 - DNA, 637 bp, Homo sapiens
  misc_feature: GZ8MTXP02JP04Y.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccgagccgtgggggtccctgagactctcctgtgcagcctcgtggccttcaccgtcagtagcagctacatgccacgtcgggtccgccgaggcctaccggaaggggaacggggtcgtgggaggtgggtctacgtagtttacttaactaacttcgtacggtaccactactacctaccgtcccgaccccggtaggaaaccgggccgtaacttaaccaatcctaccgagaacgaccgtattacccggaagtaacgacggttagtaacttcttacaaaacttcgaaacctaacgtgacgacgaccgaacgaccgtacgggttacctttatacgtgtagacgtagtagtacgttggacggttcggggttaccggacctccgtaccgttggttcctacgtcgactccgtcggtcggggtccaacgg

SEQ ID NO: 409312 - DNA, 670 bp, Homo sapiens
  misc_feature: GZ8MTXP02HAR0E.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagcttgggtttttcttgttgctatttcaaaaggtgtccagtgtgaggtgcaggtggtggagacgtggaggaggcttgatccagccgtgggggtcctgagactctcctgtgcagcctctggcttcaccgtcagtagcagctacatgcacgtcgggtcccgccgaggcctaccggaaggggaacggggctggggacgtggggtctacgtagtttaatttacaactttcgtacggtaccaactactaaccttaccgtccccgaacccccggttaggaaaccgggtacccgtaaactttaaacccacttcccgtaaccgaagaaacggtaacgtacgttaacccggaaagaaaccgtaacgggttattaaacttcgttaaaccaaaagtacgaaaacctaaaccgtggaacgacgacccgaagaccgtacggtacctttatacgtgtacgacgaagtagtagttcggaggtcggggttaccggcctaccgaccgttggttaacctacttccggatccgtcggcggggtccgtcg

SEQ ID NO: 409313 - DNA, 588 bp, Homo sapiens
  misc_feature: GZ8MTXP02F8N9Y.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccgccaggctaccgaggggtaacggggctgggagtgggtctcgagttatttacaactttctgtaaccactatacctactcccgacccgtgaacggccgaattaaccatcctaccaagacgacaagttaccgaagaaacgacggtagtacttacttacaaaatacgaaaccaaacctagagacgccgaacgaccacggtaccgtttatacgtgtgcgagacgtattcgagtcgggttacgggaccttcgacccgttggtaaccttacgttcgactccgttcgcgggggtcctcgg

SEQ ID NO: 409314 - DNA, 699 bp, Homo sapiens
  misc_feature: GZ8MTXP02JZZ63.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtcccgccgaggcctaccggaaggggaacggggcgtaggggacggttggggtctacgtaaggtttatttaacgtaacttccgtacggtaaccacgtactacctaccgtccccggaaccccgtggaaaccgggccgtattaaacccgattacccgtaccgaaggaaacgaccgtaacgttacccggaaagtaaccgacggttagttaacttacttacaaaattacgaaactaacccgtagacgacgacccggaaccgtaaccgaccggttacccgtttaagttacgtgtacgacgaagtaacgtacgtttacgggacggttacggggttaccggggaaccctcccgtacccgttagggtttcccttaaccgttcgtacgttccgttcggtccgggggtccgtcccgggg

SEQ ID NO: 409315 - DNA, 649 bp, Homo sapiens
  misc_feature: GZ8MTXP02FUKI3.3.82.H05.1.454.CMB.2.raw
  modified_base (298)..(298): a, c, t, g, unknown or other
  modified_base (449)..(449): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctcgtggcttcaccgtcagtagcagctacatgcacgtgggtccnccgaggctccgaggggaaggggcgtagggaggtggggtctacgtaggtttaactttacgaatttcgtacggtaccactatacctaccgtcccgacccgtggaacgggcccgtaattaaccatcctacgagacgacgtattaccgaagaacncgggttataactcttacaaaagttacgaaaaccctaaccgtaggaacggaccgacccgggaaacgaacccgtaccgggtaccgttttaataacgtggtacgacggaagtacggtagtttacgggagggttcggggttaccgggaccttcgaacccgttggtttaacctacgttacgacttcgtcggtacggggtcctcgg

SEQ ID NO: 409316 - DNA, 597 bp, Homo sapiens
  misc_feature: GZ8MTXP02GNF0N.3.82.H05.1.454.CMB.2.raw
  modified_base (282)..(282): a, c, t, g, unknown or other
  modified_base (359)..(359): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttggtcgggcgacgtcggtacggttttaacagtattgggttagtctggtatcagcaagaaaccagggaaacnccctagacgttcctagatgtctgctgcactcccacctgacaaagtcggacgtcccatccagtattcagtcgtcagtnagtcgaggacagtacgttacactcctacacctatcaagcacgcctgacacgcctagaaacgttatttacgacttaactttactattacgtacaaacgtaggtacctagaacctcgttcccgtcccgtacttcgtacccgtttcgggggaccggggaaacgggaaccgtaaaggggtacggaacgttaacgaaaccgtaaaacggtaacgttcgggtacgtaccgtcggaccctaaccg

SEQ ID NO: 409317 - DNA, 692 bp, Homo sapiens
  misc_feature: GZ8MTXP02ISSS3.3.82.H05.1.454.CMB.2.raw
  modified_base (254)..(254): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccatccgtgggggtccctgagactctcctgtgcngcctctggcttcaccgtcagtagcagctacatgcacgtcgggtcccgccgaggcctaccggaggggaacggggcgtgggaggttcgggtctcgtagtttactttacaactttcgtacggtaccactactacctacctcccggaccccggtagaacgggggcctaaactttaaaccattccctaccgaagtacgacgtacttacccggaagaaccgtacgggtatacgttccttaaacgaaaacgttacgaaacctaaccgtagggaacgaccggacccgaacggaaccgtaccgggttacctttaagtacgttacgggacggtacggaaggtaaggttacttaccggggtaaggttccgggggttacccgggtaacccctccgtaacccgttcgggtttaccttaccggttcgtacgttccgtttacggtcccggggg

SEQ ID NO: 409318 - DNA, 734 bp, Homo sapiens
  misc_feature: GZ8MTXP02HL7ZH.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctggcttcaccgtcagtagcagctacatgcacgtcgggtccgccgaggcctaccgaggggaacgggggctggggaggttggggtcctacgtagtttaactttaacaagtttccgttaggtacccaactattaacccttaacctccccgggtaacccccgtaggaaacggggtccccgtaaactttaaacccgattaccctacccgaaggaaacgtaccgtaacgtttacccggaaagaaaacccgtaggggttacttaaacttaccttaacaaaaattacggaaaacctaaacccgttaggaaacggacggaccggaaccgaaccgtaaccgggttaccctttttaaagtaccgttaggtacgacggtaaggtaagtaacgtttcggaacgggtttcggggtttaccggggacccttacgtaccccgttggttaaccctacgttacggtacttccgtcggtcgggggtccgttacggg

SEQ ID NO: 409319 - DNA, 638 bp, Homo sapiens
  misc_feature: GZ8MTXP02IMNX5.3.82.H05.1.454.CMB.2.raw
  modified_base (293)..(293): a, c, t, g, unknown or other
tcagagacgcactccacgaccggtgctcgatttagtcgagctctctcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccnccaggctccgagggaaggggctgggagtgggtctcagttatttacaattcgtgtaccacatacctactcccgacccgtgaaacgggccgaattaaccattcctaccagacgacgaacttccggaagaaactaccggtagtactacttacaaaattacgaaacctaaacctagaacgacggacccgaaacgaccgacggtaccgtttaattacgtggttacgcggtaagtaagttacgttacgggtacgggtttacgggggtaccggtaccgtacccgtccgtttacgggttaacctttacgttaaccggtacttccggttcgggtccggggtaccggttcccggg

SEQ ID NO: 409320 - DNA, 546 bp, Homo sapiens
  misc_feature: GZ8MTXP02I6OTJ.3.82.H05.1.454.CMB.2.raw
  modified_base (390)..(390): a, c, t, g, unknown or other
  modified_base (415)..(415): a, c, t, g, unknown or other
  modified_base (427)..(427): a, c, t, g, unknown or other
  modified_base (468)..(468): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctattcaaaggtgtccagtgtgaggtgcaggtggtggagactggaggaggcttgatccagcctggggggtccctgagactctcctgtgcagcctctggcttcaccgtcagtagcagctacatgcactgggtccgccaggctccgaggggaggggctgggagtgggtctcgtagttattacaattctggtaccactatacctactccgacccgtggaacgggccattaaccntctaccagagacgattccgagaacncggtgtatctanaaatagaaacactgagacgccgacacacggtcgttatacgngtgcgagagattcggaggtcggttacggggcctacgacccgttggttccttacgtcgactcgtcggtcggggccctgg

SEQ ID NO: 409321 - DNA, 825 bp, Homo sapiens
  misc_feature: GZ8MTXP02G7WS6.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctcggcttcaccgtcagtggcagctacatcgcacgtcgggtcccgccgaggccgtaccggaggggaacggggcgtggggaggtggggtacctcgtagtttacctttacgtaactttcgtacggtaaccaacgtaactaccgtaccgtaccccggaaccccggtagggtaaaccggggcccgtaaacttaaacccacgtcccgtacccgaaagggaaccgtaaccggtaacgtttacccggaaaggtaaacccgtacgggggtttactaaacttaccggtttaaacaaaacgttaaccggaaaaccgttaaaccccgtagggaaaccgggaaccggaccccggtaaaccggaaaccgggttacccgggttaacccgtttttaagttaccgtagggttcgggaaccggtaaagtaaacgggttacgtttaccggggaaacgggggtttccgggggtttaaaccccgggggtaacccctttacccggtaaaccccggttttcggggtttaacccctttacggtttaccccggtaaacgtttcccggtttaacggggtttccccggggggg

SEQ ID NO: 409322 - DNA, 638 bp, Homo sapiens
  misc_feature: GZ8MTXP02HRE5F.3.82.H05.1.454.CMB.2.raw
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgtacttggtcgggcgactcggtacggttttaacagtattggttagtctggtatcagacaagaaaccgagggaaacgcccctgacgttcctgatgtctgctgcactcccacccgtgacaaaggtcggacgtcccatccagtacttcagtccgtcagtagaatcgtacggggacaggtacgtttccacttctaccaacctatcaagcaacgtcctcgaccacgtccgtagtaaacgttagttttacgaccttaaactttactaattacggtaactaaacgacgggtcttaggaacctcggttccccttcccgtcgtttaccgtaaccggtttccggggacccggggtaacggggtaaacccgtaaggggttacggaaacgtaaaccggttaaccgaaaaccggtacgtttcgggacggtactttaaccgg

SEQ ID NO: 409323 - DNA, 573 bp, Homo sapiens
  misc_feature: GZ8MTXP02JYXAO.3.82.H05.1.454.CMB.2.raw
  modified_base (506)..(506): a, c, t, g, unknown or other
tcagagacgcactccacgaccggtgctcgatttagtcgagctctctcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccgccgaggcctccggaaggggaacggggctagggaggtgggtctactaggttatttacaattctggtaccagtatacctactcccgaccccgtggaacggccgattaaccatcctaccagacgacgacttaccgaagaacacggtgtaatcttacaaatcgaaacaacctgacgacgccgaacgacgaccggtctttatacgtgtagcgagngagttcgacggttcggtcgggacctcgacccgttggttcctacgtcgactccgtcgtcggggctcgg

SEQ ID NO: 409324 - DNA, 620 bp, Homo sapiens
  misc_feature: GZ8MTXP02FUDOQ.3.82.H05.1.454.CMB.2.raw
  modified_base (296)..(296): a, c, t, g, unknown or other
  modified_base (330)..(330): a, c, t, g, unknown or other
  modified_base (359)..(359): a, c, t, g, unknown or other
  modified_base (384)..(384): a, c, t, g, unknown or other
  modified_base (394)..(394): a, c, t, g, unknown or other
  modified_base (410)..(410): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcgtgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggccnccgaggctccgaggggagggctgggagtggtctnagttattacaattctgacactatactacnccgacccgtgaacggccattaaccntctaccaganacgataccgaagaacncggtatactctacgaaattacggaaactaaaccgtgaacggacgacccggaacgaaccgtacggtacccgttttatacgtgtacgacggagaagttacgttcggtaacgggtcggggttacccggggtacccttaccgtaacccccgttggggtttccctaacgttttccggaactttcccgtacggtccggggggtacccttcccgggg

SEQ ID NO: 409325 - DNA, 580 bp, Homo sapiens
  misc_feature: GZ8MTXP02IN2H7.3.82.H05.1.454.CMB.2.raw
  modified_base (424)..(424): a, c, t, g, unknown or other
  modified_base (453)..(453): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtggtccgccaggcctccgagggaagggctgggagtgggtctctagttattacaattctgtaccacatacctactccggacccgtgaacgggcctaattaaccactctaccagacgagactccgaagacgacggtntactcttacaaatcgaaactacctagganacgccgaaccgacaccggtcctttaataccgtgtcgacgagaagtgttacggagggttcgggtaccggggaccttacgtacccgttggttaacctacgttacgacttcgtcgtcggggccgtaccgg

SEQ ID NO: 409326 - DNA, 763 bp, Homo sapiens
  misc_feature: GZ8MTXP02I1SHY.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcagggtggtggagacgtgggaggaggcttgatccgagccgtgggggtccctgagacctctcctgtgcagcctcgtggcttcaccgtcagtacgcagctacatcgccacgtcgggtcccgccgaacggtccgtaccgggaagggggaacgggggtcgtaggggtagggttcgggttcctacgttaagtttaactttaacctaagtttcgtacggtaaccaacgtaacttccgtaacccgttaccccggaccccggttaggaaaccggggtaccctaaacgtttaaacccacttccctacccgtaaggaacggaaccgtaacgttacccggaaacgaaccgtacgggttacgttaacttacttaaaccgaaaacttacgaaaacccgtaccgttaagggacgaacccggacccgaacggtaacccgtaccgggtttacgttttaattaacggtggttacgggaacgagttaaaggtacggtttacggaacgggtttccgggggttacccgggacccttaccgtccggtttacggtttacttaccgttacgtacgtccgtacggggttccgggg

SEQ ID NO: 409327 - DNA, 852 bp, Homo sapiens
  misc_feature: GZ8MTXP02H9HVJ.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactgggaggaggcttgatccaggccgtgggggtccctgagactctcctgtgcagcctctggcttcaccgtcagtagcagctacatgccacgtcgggtcccgcaggccgtaccggaggggaacggggtcgtaggggaggtcggggtctacgtaaggtttatttaactaacgtttccgtacggtaacccacgtaacttaacccgttaacccgtccccggaacccccgggttaggtaaaccgggggaccctaaactttaaacccgacttacctacccgaagacggtaaccgtacgtttaccccggaaaggtaaaacccgtacgggggtttacttaaacttacccgtttaacgaaaaaacgttacggaaaaacccctaaaccgttacgggaaacggaacccgggacccgaaaacccgggtaaccgtaacccgggggtttaccctttttaaacgttaccgtttggggtacggaaccgggtaaggtaacggttaacggttttaccgggggtaacgggtttaccgggggtttaacccgggggtaccccttaacccggttaccccggtttcgggggtttttaaccccgttaaaccggtttccgggtaccgtttcccggtttacccgggggttaccggggggtccccgtttaacccggggg

SEQ ID NO: 409328 - DNA, 581 bp, Homo sapiens
  misc_feature: GZ8MTXP02IZ7JL.3.82.H05.1.454.CMB.2.raw
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcggtcggttttaacagtagtggttagtctggtatcagcagaaaccagggaaacgcccctagacgttcctgatgtctgctgcactcccacctgacaaagtgacgtccatccagtacttcagccgtacagtgtaatccgtagggactagtacgttcacgtctacacctatcagcacgtcctagacacgcctagaacgttattttacgaccttaaacgtttactaacgttcgtaacgaacgtaggtacctgtaaaccgtcgttccctcccggtcttaccgttaccggtttcgggacgggtaacgggaaccgtaaggtaggaagacgtaaacgaaaacggtactcggtacggtactacg

SEQ ID NO: 409329 - DNA, 734 bp, Homo sapiens
  misc_feature: GZ8MTXP02H1QN6.3.82.H05.1.454.CMB.2.raw
  modified_base (255)..(255): a, c, t, g, unknown or other
  modified_base (261)..(261): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccaggccgtgggggtccctggagactctcctgtgcngcctcnggccttcacgtcagtacgcagctacatgcctacgtcgggtccgccgacggcctaccggaaggggaaggggtcgtggggtaggttcgggtcttacgttaagtttactttaacgtaacgtttcgtacggtaacccactaacttaccgtacccgtccccggaacccggttaggaaccgggtaccgtaaacttaacccactccgtaaccgaaggaacgtaccgtacgttacccgaagtaaaccgtacgggtattaactacctttacaaaacgtacgtaaaacctaaccgtaggaacgacggacccggaacgtaacgtacccggttacgtttttaactacgtacggtacggacgaaaggtacggtaacgtttccggggacggtttccgggggttacccgggtacctacccgttcccgtttacggtttaaccgttacgttacgtaccgttccgttaccgggtcgggggtcccgtccggg

SEQ ID NO: 409330 - DNA, 575 bp, Homo sapiens
  misc_feature: GZ8MTXP02F6RNG.3.82.H05.1.454.CMB.2.raw
  modified_base (432)..(432): a, c, t, g, unknown or other
  modified_base (437)..(437): a, c, t, g, unknown or other
  modified_base (444)..(444): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgaggggagggctgggagtgggtctgagttatttacattcgtgtaaccactatacctacctcccggacccccgtaggaaacggggcccgtaacttaaccatcctaccagagacgattcccgaagaacncggtntatctanaaatgaaacaactgagacgaccgacgaaccacggtacctttatacgtgtacgcgaagagtattcggaggttcgggtaccggggacctccgacccttggttcctactacgactcgtcggtcggggccctcgg

SEQ ID NO: 409331 - DNA, 664 bp, Homo sapiens
  misc_feature: GZ8MTXP02IWUK6.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagactggaggaggcttgatccagccgtgggggtccctgagactctcctgtgcagcctctggcttcaccgtcagtagcagctacatgcacgtcgggtccgcaggctccgaggggaaggggctgggagtgggtctcgtagttattacaattctacggtaccactatacctacctcccgacccgtaggaacgggcccgtaattaaccattcctaccgagacgaccgaattcccggaagaaaccgtacggtagttactccttaccaaaattacggaaaccaaacccgtggagaccgcccggaacgaaccgtacgggtacccgttttaagttaaccgtggttacggaccgtaaggaacggtagtttaccgggaagggtttcggggttacccgggggacccttaccgtaaccccgttgggttaacccttaaccgttcgtacttccgttccggtcgggggtccccgttacgggg

SEQ ID NO: 409332 - DNA, 738 bp, Homo sapiens
  misc_feature: GZ8MTXP02I425O.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgcaggtggtggagacgtggaggaggcttgatccagccgtgggggtcctgagactctcctgtgcagcctctcggcttcaccgtcagtagcagctacatcgccacgtcgggtccgccgacggccgtaccggaagggggaacggggcgtaggggtaggttcggggtccttacgttaaggtttaacttttaactaaacgtttccgtacgggtaaccctaacgtaacttaaccgttacccgtcccccgggtaaccccggttaggaaaccggggtaccctaaacttaaaccgacttcccaccgaaggaacgaacgtacgttacccggaaagtaaaccgcggggttattaactaccttaaacaaacgttacgaaaacctaaccgttaggaagaccgaccggaaacgtaccgtaaccgggttacctttaaattacgtggttacgacgaagagtacgtttcgggaacggtttcggggttaccgggacccttacccgtaacccgtttggttaacccttacggtccgtacgttccgtcgggttcgggggtccctccggg

SEQ ID NO: 409333 - DNA, 704 bp, Homo sapiens
  misc_feature: GZ8MTXP02JPFHY.3.82.H05.1.454.CMB.2.raw
  modified_base (488)..(488): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtcctgagactctcctgtgcagcctctggcttcaccgtcagtagcagctacatcgcacgtcgggtccgccgacggcctaccggaggggaacggggcgtgggaggttgggtctcgtaagtttactttactaacgttcgtacggtaaccaactacttaaccttaccgtccccgtacccggtaggaaacgggaccctaacttaaaccacttcctacccgaagacgaaccgtacgttacccggaaagaacgtaccgggttntaacttacctaacgaaaacgttacgaaaacctaacgtggaagaaccgacccggaaacgtaaaccgtaccgggttaccgttttaagtaccgtggtacgacggtaagtacggtagttcgggagggttcggggtttaccggggaccttacccgaacccgtttgggttaacccttacggttaccgtacgttccgtccgggttcgggggacccttaccggg

SEQ ID NO: 409334 - DNA, 667 bp, Homo sapiens
  misc_feature: GZ8MTXP02JQM83.3.82.H05.1.454.CMB.2.raw
  modified_base (480)..(480): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcagggtggtggagacgtggaggaggcttgatccagccgtggggggtccctgagactctcctgtgcagcctctggcttcaccgtcagtagcagctacatgctacgtcgggtccgccaggcctaccggaggggaacggggctgggagtgggtctacgtagtttattactaattcctaggtacccactactacctaccgtcccgaaccccgtaggaaacgggtccgtaattaaacccattcctacccgaaaggtaacgtaacgtacttacccggaaagtaacgtaccggggttntaacttccttaacaaaaagttcgaaaacctaaccgtaggaacgacggtacccgaacgaccgtaccgggttacctttatacgtggtagacggtagtaacgtacgttcggacggttcgggggttaccggaaccttccgtaacccgttggttcctacgtttcgacgttcgtccggtcgggggtccgtcgg

SEQ ID NO: 409335 - DNA, 665 bp, Homo sapiens
  misc_feature: GZ8MTXP02HLLWO.3.82.H05.1.454.CMB.2.raw
  modified_base (368)..(368): a, c, t, g, unknown or other
  modified_base (474)..(474): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagacgtgggaggaggcttgatccaggccgtggggggtccctgagactctcctgtgcagcctctggcttcaccgtcagtagcagctacatgcacgtcgggtccgccgaggcctaccgaggggaacggggctgggagtgggtctcgtagttatttacaattcgtaggtaccanactactactcccgacccgtagaacgggccctaagttaaccatcctaccgaagacgtaacgacgttacccggaagaaaacgtcggttagttaactttacccttaaanaaagtacgaaacctacgtaggaacgacgacccgaacgaaccgtaccggttactttaacgtcgttggtacgacgtaacggtaggtacgtttcgggtacgggttccggggttacccgggtaccctacccgtacccggttagttaacccgttacgttcggtacgttccggttccggggtcggggtaccgtccgg

SEQ ID NO: 409336 - DNA, 669 bp, Homo sapiens
  misc_feature: GZ8MTXP02IZYVG.3.82.H05.1.454.CMB.2.raw
  modified_base (604)..(604): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccagccgtgggggtccctgagactctcctgtgcagcctctggcttcaccgtcagtagcagctacatgcacgtcgggtccgccgaggcctacccggaggggaacggggcgtagggaggttcggggtaccttcgtaagtttaaacgtttaactaacgtttcgtacgggtaacccaacgtaacttaacccgttacccgtcccccggtacccccgggttaaggaaaccgggggtaccccgtaactttaaaacccacttacccgtacccgaaagaacggaaccgtacgttacccgaaacgaaactacggtgtaacttacgttacaaagtacgaaacaaccgtagaagacgccggaacgacgacggtccgtttatacgtgtgacgagacgngttacggagttcgggtacggacctcgtaccgttgtctactcgacttcgtcggtcgggaccgtcgg

SEQ ID NO: 409337 - DNA, 629 bp, Homo sapiens
  misc_feature: GZ8MTXP02JITYR.3.82.H05.1.454.CMB.2.raw
  modified_base (447)..(447): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgccatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccgccgaggctaccggaggggaacggggctagggaggtgggtctcgtagttatttacaattctggtaccactatacctactcccgaccccgtggaacggggcctataaccatctaccagtacgacgtacttccggaagtaaccgaacgggttntactacttaacaaagtacgaaacctaccgtagaacgacgaccgaacgaccgtaccggttaccgtttaagtacgtggtacgacgaagtacggtacgttcggtagggttaccggggttaccgggacccttacgtaccccgttggttaacctacgttcgtacttccgtccggtcgggcccgtcgg

SEQ ID NO: 409338 - DNA, 601 bp, Homo sapiens
  misc_feature: GZ8MTXP02FNWS7.3.82.H05.1.454.CMB.2.raw
  modified_base (361)..(361): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccgccaggctccgaggggaaggggctgggagtggggtctcgtagttatttacaacttcgtgtaccanatacctactccgaccccgtggaaacggccgtaattaaccatctaccagacgacgacttccgaagaacacgggtatactcttacaaatagaaccaacgtgacgacgacccgaagaaccgacgggttacctttagttacgtgtacgacgtaaggagtacgttacggagggttacgggttccggggaccttcccgacccgttagggttcctacgttcgtacttccgtacgtcggggtcctcgg

SEQ ID NO: 409339 - DNA, 659 bp, Homo sapiens
  misc_feature: GZ8MTXP02HZOEW.3.82.H05.1.454.CMB.2.raw
  modified_base (442)..(442): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggcctccggaggggaggggcgtagggagtgggtctctagtttatttacaatttctacggtaccactatacctactcccgacccgtagaacgggccgtataaccatcctccaagacgaacgtatcccggaagtaaccacgggtntaatccttacaaaattcgaaaaccaaccgtggaacgacgacccggaaaccgtacgacccggggttaccttttaaactacgtgggtagaccggtaaggtacgtacgtttaccgggtaagggttcgggggtttacccggggaacccttccggtaaccccgtttggggtttaacccttaacgtttcggaccttccgtccggtcgggggtcccgttaccgg

SEQ ID NO: 409340 - DNA, 695 bp, Homo sapiens
  misc_feature: GZ8MTXP02HJEU8.3.82.H05.1.454.CMB.2.raw
  modified_base (257)..(257): a, c, t, g, unknown or other
  modified_base (270)..(270): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctntggcttcaccgtnagtgcagctacatgccacgtcgggtccgccgaggcctaccggaggggaacggggctgggagtggggtctacgtagtttattacaactttcgtagtaccactacgtaacctaccgtcccgaccccggttaggaaaccgggtaccctaacgttaacccacttcccgtacccgaaggaacgtaccgtaacgttacccggaaagtaaaaccgtcgggttagtaacttaccttaaacaaaagttaccgaaaaccgtaaaccgtggaaacgaccggacccggaaaccgaaccgtacccgggttacgtttttaataacgtggtaccgaggtaaggtaacgtacgtttcgggaagggttcggggttaccggggacccttacggaccctttgggttaacctacgttcgacttccgttcggcggggttcctacgg

SEQ ID NO: 409341 - DNA, 654 bp, Homo sapiens
  misc_feature: GZ8MTXP02HKYRO.3.82.H05.1.454.CMB.2.raw
  modified_base (248)..(248): a, c, t, g, unknown or other
  modified_base (272)..(272): a, c, t, g, unknown or other
  modified_base (275)..(275): a, c, t, g, unknown or other
  modified_base (278)..(278): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcgtggtttcgtgtaggctattacaaaaggtgtccagtgtgaggtgcaggtggtggagactggaggaggcttgatcagccgtgggggtccctgagctctctgtgcngcctctggccttcacgtcagtagnacncantcgacgcgtcggccgcgacgtcgacggaggggaggtcgtgggaggtcggtactacgtaagttacgttaactacgttcgtacgtaccactactacctaccgtcccgtaaccgtaggaaccggtaccaacttaccacgtccaacgagacgtacgtacgtaccgaagacgtaggtactactactaaacgaaacgtaacgaaacgaacgtacgacgacggaccgaaccgaaccgtaccggtacgttacgttacgtacgtacgtacggtaacgtacgtacggttacggtacggttacgggttaccgggtacccgtaccgttaccgttaccgttaaccgttaccgttaccgtacgtaccgtccggtccgggtaccggtccgg

SEQ ID NO: 409342 - DNA, 642 bp, Homo sapiens
  misc_feature: GZ8MTXP02JMJ02.3.82.H05.1.454.CMB.2.raw
  modified_base (274)..(274): a, c, t, g, unknown or other
  modified_base (305)..(305): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcgtggtttcgtgtaggcctattacaaaaggtgtccagtgtgaggtgcaggtggtggagactggaggaggcttgatccgagccgtgggggtccctgagtactctccgtgtgcagcctgtggcttcgaccggtnagtacgcagctagactcgacgtcgtcggccncgacggcgtacggaggggtacggtcgtagggtacggtcggtactacgttagttactaacgtaccgttcgtacgtacctacgtacgttaccgtaccgtcccgaccgtaggaccggtacctaacttacgactcgtacgtacgtacgtacgtacgtacgtacgtacgtacgtacgtaaaaaacgtctacgtaacgtacgtaacgtacgtacgtacgacgacgacgtacgtacgtacgttacgtacgtacgtacgtacgtacgtacgtacgtacggtacggtacggtacggtaccgtaccgtaccgtacgtcgtacgtcgtacgtcgtcggtcggtcgtcg

SEQ ID NO: 409343 - DNA, 607 bp, Homo sapiens
  misc_feature: GZ8MTXP02JRU97.3.82.H05.1.454.CMB.2.raw
  modified_base (452)..(452): a, c, t, g, unknown or other
  modified_base (460)..(460): a, c, t, g, unknown or other
  modified_base (475)..(475): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggccttcaccgtcagtacgcagctacatgcacgtcgggtcccgcgaggcctccggaggggaaggggcgtgggagtggggtctcgtagttacttacattctacggtaccactactactaccgtcccgacccgtagaacgggccgaacttaaacccatacctacccagacgacgattaccgaagaactacggtntatactanaaatagaaccaacgngagacgccgaacgacgtacggtaccgtttataccgtagtcgacgagagtacgttcggtaaggttcgggttaccgggaccttccggaacccgttcgggtttactacgttacgtacttccggtcggtccggggg

SEQ ID NO: 409344 - DNA, 719 bp, Homo sapiens
  misc_feature: GZ8MTXP02HH9MK.3.82.H05.1.454.CMB.2.raw
  modified_base (256)..(256): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctattcaaaggtgtccagtgtgaggtgcaggtggtggagactggaggaggcttgatccagccgtgggggtccctgagctctcctgtgcagcctntggcttcaccgtcagtagcagctacatgccacgtcgggtcccgacgacggcctaccggaaggggaacggggtccgtaggggtaggtcggggttacctacgtaagtttactttaacgaaatttccgtacggtaacccactacttacctacccgtcccggaaccccgtaggaacggggtaccgaaactttaaacccgattccctacccaaggacgtaaccgacgtttaccggaaacgtaaacgtacggttagtacttacgttaaacctaaaagttaccaaaaccgtaaccccgtaggaacgggaacccgtaacccggaaccgtaacggtacccgggtaaccgttttaagttaaccgtggtacgaacgtaggagttacggtttacggaggtttccgggggttacccgggaaccctcgtaacccgttcggttacctaccgttgaaccgttcgttccgggtaccgggg

SEQ ID NO: 409345 - DNA, 623 bp, Homo sapiens
  misc_feature: GZ8MTXP02JF75L.3.82.H05.1.454.CMB.2.raw
  modified_base (285)..(285): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgtacttggtcgggcgacgttcggtacggttttaacaggtattggttagtctggtatcagcaagaaaccgagggaaacncccctagacgttcctgatgtctgctgcactccacctgacaaaggtcggactcccataccagtacttcgagtcgtcgagtacgatcggtagggaactagtacgttcaccttcctaccacctatcacgtccacgcctcgacgtacgacctagtaagttacgttttacgaaccttaaacctttacttaagtttacgtaacctaaacgacggtaccgtagtaccgtacggttccctccccgtacttacccgtacggtttaccggggacgggtaaacgggaaccgtaggggtacggaacgtaacgtaacgaaaacgtcgtacggtcggtacctacggactacg

SEQ ID NO: 409346 - DNA, 640 bp, Homo sapiens
  misc_feature: GZ8MTXP02F24UD.3.82.H05.1.454.CMB.2.raw
  modified_base (295)..(295): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactgggtccnccaggctccgaggggaacgggctgggagtggggtctctagttatttacaatttcgtgtaccacatacctactcccgacccgtggaaacggccgattaacccatctaccagacgacgaacttcccgaagaaaccgcgggttataactcttacaaaatgaaacctaaccctgaagacgacccggaacgaaccgaccgggtaccgtttaattaccgaggttacgcggaaagacggtattacgggaggtttacggggttacccgggggaacccttcccgaaccccgtttagggttaacccttaaccgttcggtaacgtccgtttccggtcgggggtccccgttacgggg

SEQ ID NO: 409347 - DNA, 611 bp, Homo sapiens
  misc_feature: GZ8MTXP02JN20Q.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgaggggaaggggctgggagtgggtctcgagttatttacaattctaggtaccactatactactcccgaccccgtggaacgggcccgaattaaccatcctaccagtacgacgattcccggaagaacacggttgtaatcttacaaaatgaaacaacctgaacgacgcccgaacgacgacgggtaccgtttaattacgtacggtgacgagtaggtagtttcggaaggttcgggggttacgggggaacccttccgtacccgttgggtttaacctaccgtttcggacttccgtcggtcgggggccttcgggg

SEQ ID NO: 409348 - DNA, 636 bp, Homo sapiens
  misc_feature: GZ8MTXP02JK8FY.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgcagggtggtggagacgtggaggaggcttgatccagccgtgggggtcctgagactctcctgtgcagcctcgtggcttccaccgtcagtagcagactacatcgccacgtcggtccgccgaggctaccggaggggaagggctgggagtggtctgtagttattacacttcgtgtaccatatacctactcccgacccgtaggaaccgggtcctaactaacccatccctacgagaacgaccgtacgtaccgaagtaacgtacggtacttacgttactaaacaaagtaacgaaaccaacgtaggaacgaccggacccgaaacgacccgtacgttacctttaagttcgtggaggacgaagtacgttacgtcgggtacggttcggggtaccggtaccctaccggtaccgttggtaacctacgttacgtcgtcgtcgggtccgggccgttaccgg

SEQ ID NO: 409349 - DNA, 649 bp, Homo sapiens
  misc_feature: GZ8MTXP02JJTIR.3.82.H05.1.454.CMB.2.raw
  modified_base (260)..(260): a, c, t, g, unknown or other
  modified_base (309)..(309): a, c, t, g, unknown or other
  modified_base (496)..(496): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcgagggtggtggagacgtggaggaggcttgatccgaggccgtgggggtccctgacgactctcctgtgcncgcctcgtcggtcttcaccgtcagtagcagctacatgcacgtcggtccnccgaggcctaccggaggggaacgggcgtagggacggtggggtctacgtagtttacttacgtaatttcgtacggtaccactactaccgtaccgtcccggaccccggtaggaacggggtaccctaaacgttaaaccctatccgtaccgaacggacgaaccgtacgttaccgaacgaaccgtacgggttntactacgttaaacaaacttacggaaaccacgtgaaggaccgaccgacgacgtaccggttacctttataccgtgtacgacgagtatacgtcggtacggtcgggtaccggacctcgtaaccgttcgttactacgtctacgtccgtacggtccggg

SEQ ID NO: 409350 - DNA, 592 bp, Homo sapiens
  misc_feature: GZ8MTXP02G925H.3.82.H05.1.454.CMB.2.raw
  modified_base (281)..(281): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttggtcgggcgactcggtacggttttaacagtattggttagtctggtatcagcaagaaaccgagggaaacncccctgacgttcctgatgtctgctgcactccacctgacgaaagtcggaactcccaatccagtattcagcgtacagtagattcgagggacagtcgtacactcacacatcagcagccctgacacgtcctagaattactttagaacttaactttactatttacgaaccaaacgtggactacgaacgtcttcccgtcccgacttaccgttaccggtttccggggaccgggtaaacggggaacccgtaaaggggttacggaaacgtaacgtaacccgaaaaaggtaccgttgggacggtcccttagacccctaacg

SEQ ID NO: 409351 - DNA, 623 bp, Homo sapiens
  misc_feature: GZ8MTXP02HAC84.3.82.H05.1.454.CMB.2.raw
  modified_base (256)..(256): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctntggcttcaccgtcagtagcagctacatgcacgtcgggtccgccgaggcctccgaggggaaggggctgggagtgggtctcgtagttatttacaactttcgtcggtaccacgtatacctacctcccggacccgtaggaacgggccgtaattaacccattcctacagacgacgtacgttaccgaagtaactacgggttattacttcttaacaaaagttacgaaacctaaccgtgaagaccgaccgaacgactaccggtaccgtttataacgtgtacgacgtagagtacttgggaacggttcggggtaaccgggtccctaccgtacccgttggttaaccttacgtcgtacttcgtcggtcggggcctccgg

SEQ ID NO: 409352 - DNA, 586 bp, Homo sapiens
  misc_feature: GZ8MTXP02F7BS9.3.82.H05.1.454.CMB.2.raw
  modified_base (404)..(404): a, c, t, g, unknown or other
  modified_base (507)..(507): a, c, t, g, unknown or other
  modified_base (516)..(516): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagactggaggaggcttgatccagccgtgggggtccctgagactctcctgtgcacgcctctcggctcaccgtcagtagcagctacatgcacgtcgggtccgccgaggctccggaggggaaggggctgggagtggggtctcgtagttattacaacttctggtaccactatacctactcccggacccgtggaacggccgtaattaaccntcctacgagacgacgtattaccgaagaacgtacggtattaacttccttaaacaaagtacgaaacctaaccgtgaacgacgaccgacgacgacgtacttatacngtacgcganagtagttcgaggttcgggtcggacctcgtaccgttgtccttacgtcgactcgtcggtcggggtcctacgg

SEQ ID NO: 409353 - DNA, 573 bp, Homo sapiens
  misc_feature: GZ8MTXP02HS7UV.3.82.H05.1.454.CMB.2.raw
  modified_base (300)..(300): a, c, t, g, unknown or other
  modified_base (347)..(347): a, c, t, g, unknown or other
  modified_base (357)..(357): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttggtcgggcgactcggtcggttttaacagtattggttagtctggtatcagcaagaaaaccgagggaaacgcccctgacgtttccngattgtctgctgcatcccaccctgacaaagtgacgtcccatccagtnttcagcgtcngtgaaatcgtaggggaactagacgttcaacttcacacatcagcagcctgacagtcctagaacgttattttagactaaacttactatttgacaacgaggctagactacgtccctcccggcttccgtaaccgtttccggggacgggaacggggaacccgtaaaggggtacggaacgtaacgtaaaccgaaaaccggtaacgttgggtacggactaccg

SEQ ID NO: 409354 - DNA, 664 bp, Homo sapiens
  misc_feature: GZ8MTXP02JKJOU.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctggcttcaccgtcagtagcagctacatgcctacgtcgggtccgccgaggccgtaccgaaggggaaggggcgtgggaggtggggtctcgtagtttactttacaactttcgtaggtaccactactacctaccgtcccgtaccccgtaggaaacgggtccctaagttaaccactcctacccgaagacgtaccgtattacccgaagtaaaccgacgggttagtaacttcgtaacaaaagtacgaaacctaaccgtgaacgacgacccggaacgtaccgacggttacccgtttaattacgtggtacgacggaagtaacgtagttaccggtaacgggtttcggggtacccgggtacctccgtaacccgttggttaaccgttacgttcgacttccgtacggtccggggtctcgg

SEQ ID NO: 409355 - DNA, 647 bp, Homo sapiens
  misc_feature: GZ8MTXP02IDK70.3.82.H05.1.454.CMB.2.raw
  modified_base (263)..(263): a, c, t, g, unknown or other
  modified_base (301)..(301): a, c, t, g, unknown or other
  modified_base (320)..(320): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagtcttgggttttccttgttgtctatttacaaaaggtgtccagtgtgaggtgcaggtggtggagacgtgggaggaggtcttgatccagccgtcgggggtccctgacgactctcctgtgcncgcctcgtcggcctccgaccgtcagtagcagtacctanatgccgtacgtcgggcccncgacggcctacggaaggggaacggggcgtagggaggtcgggtactcgtagtttacttaactactcgtacgtacactactacctaccgtacccgacccgtagaaccgggtcctaaacttaaccaacttccaccgtaagacgaacgtactaccggaaagtaacgacggttagtactactaaactaaactacgaaactaaccgtagacgggacaccgaacgtacgacgttacgttaactacgtagtcgacgaggtagacgttacggacggttacggtacccgggtactcccgaaccgtttgtaccttacgtcgtactcgttcggtccggg

SEQ ID NO: 409356 - DNA, 556 bp, Homo sapiens
  misc_feature: GZ8MTXP02F7FB8.3.82.H05.1.454.CMB.2.raw
  modified_base (423)..(423): a, c, t, g, unknown or other
  modified_base (440)..(440): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagccgctggcttcaccgtcagtagcagctacatgcacgtcgggtccgccaggctccgaggggaaggggcgtgggagtggggtctcgtagttatttacaattctaggtaccacatacctactccgacccgtagacgggtcgattaaccatctaccagacgacgtattccganaacgacgtgtactctanaaatgaacacctgacgacgccgaagcgacggtcgtttatagtgagacgagagacttaggacggttcgggtcgggacctcgaacccgttggttactacttacgctcgtcgtcggggg

SEQ ID NO: 409357 - DNA, 628 bp, Homo sapiens
  misc_feature: GZ8MTXP02HZWZ0.3.82.H05.1.454.CMB.2.raw
  modified_base (276)..(276): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtcctgagactctcctgtgcagcctctggcttcaccgtcagtancagctacatgcacgtcgggtcccgcccgaggcctaccggaggggaacggggctggggagtcggggtctcgtagtttactttacaatttcgtacggtacctacacttacctacctacccgaaccccgtaggaaacggggcccgtattaaacccgatcctccgaagacgacaagttacccgagtaacgacggtagtactacttacaaaattcgaaaacctaaccgtagaacgacgaccgaacgacgtaccggacgtttattacgtgtacgacgagtagtagttacggaggttcgggttaccggggaacccttcgaacccgttggttacctacgttcgtacttcgtcgtccgggg

SEQ ID NO: 409358 - DNA, 685 bp, Homo sapiens
  misc_feature: GZ8MTXP02FWQ0Z.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctcgtggcttcaccgtcagtagcagctacatcgcactgggtccgccgaggcctaccgaggggaaggggctgggagtgggtctcgtagtttatttacaacttcgtcggtaaccacgtactaacctaccgtcccggaccccgtaggaaacgggtaccctaacgttaaacccatccctacccacggaacggacgtaacttacccggaaaggtaaaccaccggggttattaacgttacttactaaaacgtacgaaaacctaaaccgtacgagaacggacccggaacgaaccgacgggtaccgtttaacttacgtcggtagacgtaaggacgtacgtttacggtacggttacgggttccgggggtacccttaccgtacccgtttacggttccgttaccgttacgtacgttcgttccggtcgggggtccgttcccggg

SEQ ID NO: 409359 - DNA, 813 bp, Homo sapiens
  misc_feature: GZ8MTXP02IIP8M.3.82.H05.1.454.CMB.2.raw
  modified_base (261)..(261): a, c, t, g, unknown or other
  modified_base (279)..(279): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagacgtgggagggaggcttgatccaggccgtggggggtccctgagactctcctgtgcagcctntggcttcaccgtcagtancagctacatgccacgtcgggtccgccgaggcctaccggaggggaacggggctgggaggtggggtctacgtagtttatttacaactttctaggtaccactacttaaccgtacctcccggaacccccgttaggaaaacgggggtccctaacgttaaacccattaccctacccgaaggaacgtaaccgaactttacccggaaagtaaaccgtacggggttacgttaactttacccgtttaaaccgtaaaagtaaccggtaaaaaccctaaaaccccgttagggaaaacggtaaccgggaccccgggtaaaaccggtaacccgtaaacccgggggtttaacccgtttttaaagtttaaacccgttgggttacggaccgggtaaaaggtaacgttaacggtttaccgggtaaggggtttaccgggggtttacccgggggaacccttaccccgtaccccggtttacggggtttaaccttttaacccgttaccgggtaactttcccggtttcccgggttcggggggacccggtttccgggg

SEQ ID NO: 409360 - DNA, 712 bp, Homo sapiens
  misc_feature: GZ8MTXP02HAWJ8.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagggtggtggagacgtgggaggaggcttgatccagccgtgggggtccctgagactctcctgtgcagcctctggcttcaccgtcagtagcagctacatgccacgtcggtccgcgaggcctaccggaggggacgggcgtgggaggttcgggtctacgtagtttaatttaactaacgtttccgtaggtacccaactacttaaccttacccgtccccggaaccccggtagggaaaccgggtaccgtaacttaaacccacttccctaccgaagaacgacgtacttacccggaaagtaaacgtcgggttataactaccttaacgaaaacttacggaaaaccctaaaccgtacggaacgaccggaccccggtaaacgaccgtaaaccgggttcccgttttaaataccgttggtacgacgtaagtacgttaacgttcgggtaacgggttcggggttacccggggacccttaaccggtcccgtttaggtcccttacgttcgtactccgttccgggtcggggtacccgtcgg

SEQ ID NO: 409361 - DNA, 594 bp, Homo sapiens
  misc_feature: GZ8MTXP02F18VE.3.82.H05.1.454.CMB.2.raw
  modified_base (276)..(276): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttgtcgggcgactcgtcggttttaacagtatggttagtctggtatcagcaagaaaccgagggaacncccctgagttcctgatgtctgctgcactcccacctgacaaaggtggactcccatccagtattcagcgtcagtagatcgtaggggactagtacgttacactcctaccaccatcgacgcacgcccgtgccgaacgacccgtaaagttacttttacgaccttaaactttactaatttcgtaacaacgtacggactagacctacgtccctcccgtacttaccgtaccgtttaccggggacgggtaacggggaaccgtaaaggggtacggaacgtaacgttaaacgaaaacggtaactggtacggactacggacctacgtacg

SEQ ID NO: 409362 - DNA, 577 bp, Homo sapiens
  misc_feature: GZ8MTXP02JFA7P.3.82.H05.1.454.CMB.2.raw
  modified_base (334)..(334): a, c, t, g, unknown or other
  modified_base (397)..(397): a, c, t, g, unknown or other
  modified_base (426)..(426): a, c, t, g, unknown or other
  modified_base (433)..(433): a, c, t, g, unknown or other
  modified_base (447)..(447): a, c, t, g, unknown or other
  modified_base (482)..(482): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtgggtccgccaggctccgaggggaaggggctgggagtgggtctntagttattacaacttctggtaccactatacctactccgacccgtgaacgggccgaattaaccntctccagacgacgattccgagacacggtntatctanaatgaacacgtganacgccgaacgacaccggtaccgtttaatacgttgngtacgaagacgtagttcggaggttcggggttcggggaccctcgaccccttagggttcctacgttcggattcccgtacggtcgggggtccctcggg

SEQ ID NO: 409363 - DNA, 664 bp, Homo sapiens
  misc_feature: GZ8MTXP02G3OE8.3.82.H05.1.454.CMB.2.raw
  modified_base (429)..(429): a, c, t, g, unknown or other
  modified_base (442)..(442): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccagccgtgggggtccctggagactctcctgtgcacgcctctggtccttcacccgtcagtagcagctacatgccacgtcgggtccgccgacggcctaccggaggggaagggctgggagtggtctctagttaatttacaattctagtaccatactacactccgaccctggaacggccaataaccactctaccagaagacgtacttcggaanaaacgtaccggtntaacgtcttacgaaaattagaaaacccgtaacctaggagaaccggacccgtaaaccgacggtaacccggttaccgtttaaataccgtggtaccgaggtaagtaacggtacgttaaacgggacgttaggggttaccccggggtacccttaccgtaccccggtttacggtttaacctaccgtttaccggactttccgtaccgggttcgggggtcccgttaccgg

SEQ ID NO: 409364 - DNA, 567 bp, Homo sapiens
  misc_feature: GZ8MTXP02I6GNX.3.82.H05.1.454.CMB.2.raw
  modified_base (297)..(297): a, c, t, g, unknown or other
  modified_base (378)..(378): a, c, t, g, unknown or other
tcagagacgcactccacgaccggtgctcgatttagtcgagctctctcgcgggggcaggagtcagacccagtcaggacacagcatggacatgagggtcccccgctcagctcctggggctcctgctgctctggttcccaggttccagatgcgacatccagatgacccagtctccatccctccgtgtctgcatctggtaggggacaggagtcgctatgtacgttggtcgggcgtacgtcggtacggttttaacaggtagttggttagtcgtggtatcagcaaggaaacccgagggaaacnccccgtaggtacgtttccgtgtatcgtcgtgctgcctactcccacctgactaaagtcgactccatccagtactcagcgtanagtagaatcgaggactagtacttcactcacacatcagcacgcctagcacgctagaattatttacacttaacttatatcgtacaagcgtactacgactacgtccctccgtctaccgtacgttcgggacgggtaacggaaccgtaagggtacgaacgactaaaccgaaaacggtcgtcggtacggctaacg

SEQ ID NO: 409365 - DNA, 627 bp, Homo sapiens
  misc_feature: GZ8MTXP02JM331.3.82.H05.1.454.CMB.2.raw
  modified_base (271)..(271): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactgggaggaggcttgatccagccgtgggggtccctgagactctcctgtgcagcctctggcttcaccgtnagtagcagctacatgcacgtcgggtccgccgaggctccggaggggaaggggcgtgggaggtgggtctcgtagttattacaattcgtaggtaccactactacctacctcccgacccgtgaacgggccgaattaaccatctaccgagacgacgacgttccgaagaacgacggtgtaacttcttacaaagtcgaaacctaaccgtggaacgacgacccggaacgtacgtaccgggttaccgtttataccgtggtacgacgagtagtacgttacggaggtttcggggttaccgggacccttaccgtacccggttggttaaccttacttacgtacgttccgtacggtcgggggcctccggg

SEQ ID NO: 409366 - DNA, 743 bp, Homo sapiens
  misc_feature: GZ8MTXP02G9F4T.3.82.H05.1.454.CMB.2.raw
  modified_base (298)..(298): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctggcttcaccgtcagtgcagctacatgcacgtgggccnccaggctcgaggggaggggctggagtgggtctcgtagtttactttaacagttcgtacggtacccacgtactacctaccgtccccgacccccggttagaaccgggggtaccctaaacttaaacccgaactccgttacccgaagaacggtaaccgtaacgttacccggaaacgtaaaccgtaacgggttacgttaacttaccgttaaacgaaaacgttaacgaaaacccgtaaaccgttaggaacggaacgaaccccggaaccggaaccgttaacccgggttacgttttaaacgtttaaccgtggttaacggaccggtaaaggtacggtaaagtttaccgggtaacggggtttcgggggttacccgggggtaaccctttcccggtaaccccgtttacggggttacctttacccgttacggttaactttccggtacggtttccggggg

SEQ ID NO: 409367 - DNA, 932 bp, Homo sapiens
  misc_feature: GZ8MTXP02I3C8J.3.82.H05.1.454.CMB.2.raw
  modified_base (257)..(257): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtggggggtccctagacgtctctcgtgtgacncgtcctcgtcggtcctaccgtacgtcgtagtacgcgacgtacctacagtcgaccgacgggttccgggcccgaccggacggtcccgaaccggggaagggggaacggggtcggtagggtacgggttcggttcgtacgtttacgtttaaacgttaacgttaccgtttacgggtacccggtaacctaaacgttaaccgttaacccccgttaccccggtaccccccggggtaacccgggtaaaccgggggaaacccggggtaaaccccgttaaacctttaaacccgtacgtttaccccgaaaccggtaacgggtaaacccggtaaaccggtttaaacccggttaaaccggaaaacggtaaacccgggtttacgggtttaaacgtttacccgttaaaccctttaaaaacgaaacgggttaaaaccgtaaaacccccgttaagggaacgggtaaacccggtaacccgggaaccccgggtaaaaccccggtaacccccgggttaaccgttttaaccggtttaaacgtttaacgggtcggttaacggaaacgggtacgtaaaacggtttacggttaacggggttcgggggttaaccgggggttaaccccggtccttacccgttaccggtttacgttccgttacccggtagtaccgttcggtacgggggtccggtccggttaccg

SEQ ID NO: 409368 - DNA, 747 bp, Homo sapiens
  misc_feature: GZ8MTXP02G0ALT.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttacaaaaggtgtccagtgtgaggtgcgaggtggtggagacgtgggaggaggcttgatccgaggtccggtgggggtccctgacgtactctcctgtgcacgcctcgtggcttcaccgtcagtacgcacgctacatcgctacgtgggtccgccgacggccgtaccggaaggggaggggcgtgggaggtcgggtctacgtagtttaactttactaacgttccgtacgtaccactactacccgttacccgtcccggtaccccgtaggtaaaccggggtacccgtaacttaaccgtacttacccgtaaccgaggtaaaccgtacgtaacgttaccggaaagtaaaccgtacgggttacttaacttaccttaaacaaaagttaccgaaaaccgtaaaccgtaggaacgaccggtaacccggaaaccgaccggttaaccggttaccggtttaattacgggtacgtaggacgtaaggtaacgtagtttacggggacgggtttcgggggttaccgggaaccttcccgaaccgtttacggttaaccgttaaccgttcgtacgtttccgtcggggttccgggggtaccctcggg

SEQ ID NO: 409369 - DNA, 737 bp, Homo sapiens
  misc_feature: GZ8MTXP02IHTCX.3.82.H05.1.454.CMB.2.raw
  modified_base (569)..(569): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtgggaggaggcttgatccgagccgtgggggtcctgagactctcctgtcgcacgcctctcggcttcaccgtcagtacgcagctacatgactacgtcgggtccgccgacggccgtaccggaaggggaacggggcgtaggggtagggttcggggttcgggtaccgtttacgtaacggaacgaaaccccgaaccgtaaaaccgtaacgtacggtacgaacccgaacccggaccaaacgtaaacgtacccgacccggtacgttccgtaggtaacgggaaaacggccaaagtaccttaccaaaccctattaccgtaacgaaagtacgtatacgtaacttaacgagtaaactaacctttaactacttttaanactaagaaacgtaaaatcggaaaccaacggcccgtaaagaaaacccggtaacccgaaaacggacccgaaacggttacccgttaaatttacgtttaacgttcgtacgtaaacgtacgtaaacgtaccgtaaaagggttaaccaaaaccggtaacgggttaaacccgggg

SEQ ID NO: 409370 - DNA, 596 bp, Homo sapiens
  misc_feature: GZ8MTXP02IPIF2.3.82.H05.1.454.CMB.2.raw
  modified_base (437)..(437): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactgggtcccgccacggctccggaggggaacggggcgtgggagtggggtctcgtagttactttacaattctcggtaccacatacctactcccgacccgtgaacgggccgaattaaccatctaccagagacgattaccgagaacacggtntacgtcttacaaatgaaacctactagagacgccgacgacgtaccggtactttaagtacgtgtcgacgtagagtacgttacggtaacgggtcggtttaccggggcccttaccgtaaccgttcgggtttactacgttcgacgttccgtacggttccggggg

SEQ ID NO: 409371 - DNA, 601 bp, Homo sapiens
  misc_feature: GZ8MTXP02J0BR3.3.82.H05.1.454.CMB.2.raw
  modified_base (431)..(431): a, c, t, g, unknown or other
  modified_base (438)..(438): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtcccgccgaggcctccggaggggaaggggctgggaggtgggtctcgtagttatttacaattctggtaccactatacctactccgacccgtaggaacgggccattaaccatctaccagagacgataccgagacacggtntatctanaaatacgaaacaccgtgagacgaccgacgacaccggtactttatacgtgtacgtcgagtacgtattacggacgggttacggggttccgggggtaccctcccgtaacccgtttcggttaaccgttaccgtttcggacttccggtcggtcgggggtcccgtcggg

SEQ ID NO: 409372 - DNA, 780 bp, Homo sapiens
  misc_feature: GZ8MTXP02H4OH8.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctcgtcggcttcaccgtcagtgcagctacatgcacgtcgggtcccgccgaggccctaccggaggggaaacggggtcgtaggggacggttcggggttcctacgtaaggtttaacttttaacgaacgtttccgttacgggtaacccaacgtacttaaccgttaaccccgtcccgggtaacccccgttagggaaaccggggtacccgtaaacttaaacccgacttacccgtacccgaagacggtaaccgtaacgttacccggaagtaaaacccgtacgggttagttaacttacttacgaaaatacgaaacctaaacccgtggaacggacgacccggaaaccgaaccgtaccggggttaccctttttaataccgtggttacggaccggtaaaggtacgtaacggtttccggggtaacgggtttaccgggggttaaccgggggtacccccttaccgtaaccccggtttgggtttaacccttaacgttccggtacgtttccgtccggggttcgggggtaccccgtccgggg

SEQ ID NO: 409373 - DNA, 747 bp, Homo sapiens
  misc_feature: GZ8MTXP02FTXHE.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgcaggtggtggagacgtggaggaggcttgatccagccgtgggggtccctgagactctcctgtgcagcctctggcttccaccgtcagtacgcagcctacagtgccacgtcgggtcccgccgaggcctaccggaggggaacggggctgggagtcggggttctacgtaggtttaactttacgaactttcgtacggtaaccctataacgttaaccctaaccttccccgggacccccggtagggtaaaccgggggtacccctaaacgtttaaacccacgttaccctaccgaaacgtaacggtaaccgtaactttacccgggaaagtaaacccgtacgggtttacgtaaactttcttaaaccaaaagtttaccgaaaaccgtaaaccgttggaacggtaaccgacccgggaaaccgaaccgtaccggttaacccgttttagtaccgttggtaccgacgtaaggtaaggtacgttacggtacgggttcggttacccggggaccctccgtaaccccgtttggtccttaacgtcgtacgtccgttcgggtcggggaccttaccggg

SEQ ID NO: 409374 - DNA, 670 bp, Homo sapiens
  misc_feature: GZ8MTXP02FQANI.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtttccagtgtgaggtgcaggtggtggagactggaggaggcttgatccagccgtgggggtccctgagactctcctgtgcagcctctggcttcaccgtcagtagcagctacatgcagtgggtccgccaggcctccgaaggggaggggctgggagtggggtctcgtaagttatttaacgaatttccgtacggtaaccactacttaacctaccgttccccgaccccgtgggaaacggggccgtaacttaaacccattcccgtaccaagacgaacggtacttaccggaaagaaaccgacgggtagtaacttactttaacaaaatcgaaaacctaaaccgtagaacggaacgaccggaaccggaacgaaccgggtacccgtttaattaacctggtagacgtaagaaggtagtttcggaagggttcgggttaccgggggaccttcgtacccgttgggtttacctaacgttcgtacgttcgtcggtcggggtccgtcggtacccg

SEQ ID NO: 409375 - DNA, 528 bp, Homo sapiens
  misc_feature: GZ8MTXP02FPUK5.3.82.H05.1.454.CMB.2.raw
  modified_base (352)..(352): a, c, t, g, unknown or other
  modified_base (388)..(388): a, c, t, g, unknown or other
  modified_base (397)..(397): a, c, t, g, unknown or other
  modified_base (407)..(407): a, c, t, g, unknown or other
  modified_base (415)..(415): a, c, t, g, unknown or other
  modified_base (463)..(463): a, c, t, g, unknown or other
tcagagacgcactccacgaccggtgctcgatttagtcgagctctctcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgaggggaggggctgggagtgggtctcagttattacattctggtaccanatacctactccgacccgtgaaacggccgattaaccntctccaganacgatccganaacgcgtntatctacaatgaaacaactgagagccgagaccacggtcctttattacngtgcgtagagattcgagtggtcgggacctcacctggtctacttcgactctcgtcggggtccgtcg

SEQ ID NO: 409376 - DNA, 775 bp, Homo sapiens
  misc_feature: GZ8MTXP02F02EG.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggtagttttggctgagcttgggttttccttgttgctatttcaaaaggtgtcagtgtgaggtgcaggtggtggagacgtgggaggaggcttgatccaggccgtgggggtccctgagactctcctgtgcacgtcctcgtcggccttcaccgtcagtagcagctacatcgcacgtcgggtccgccgaggccgtaccggaagggggaacggggcgtggggaggttcggggttctacgtaagtttaactttacgtaactttccgtagtaaccactaacttaaccttaccgtccccggacccggtaggaaacggggtaccctaacttaaacccgattaccctaccgaaggtaacgtaaccgtaacgttacccgggaaagaaacccgtacggggttattaaaccttaccttaaacaaaacgttaccggaaaaccctaaaccgttagggaaacggaaccggacccggtaaaccggaaccccgttaaccgggtttacccgtttttaaagttaccgtggttacggacggaaggttaacggttacgtttaccggggaacgggtttccgggggttacccggggacccctttaccgtaccccgtttgggttaaccctttaacggttcgtacgtcccggttcgggcgggggtaccgtccgg

SEQ ID NO: 409377 - DNA, 557 bp, Homo sapiens
  misc_feature: GZ8MTXP02FOJ9U.3.82.H05.1.454.CMB.2.raw
  modified_base (187)..(187): a, c, t, g, unknown or other
  modified_base (481)..(481): a, c, t, g, unknown or other
tcagagacgcactccacgaccggtgctcgatttagtcgagctctctcgcgggggtagaggagcccagcactgggattccgaggtgtttccattcggtgatcagcactgaacacagaggactcaccatggagtttggctgagctgggttttccttgttgctatttcaaaaggtgtccagtgtgaggtncaggtgtgagactgaggaggcttgatccagccgtgggggtcccctgagactctcctgtgcagcctctggcttcaccgtcagtagcagctacatgcactgggtccgccaggcctccgaggggaagggctggagtggggtctcagttatttacaattctggtaccacatacctactcccgacccccgtggaaacggccgattaaccatctcccagacgacgattaccgagaacacggtgtatcttacaaatgaaacaacttgaagagcccgacgaccacggtcccgtttaattacngtgcgaagagtattcgagtggtttaccgggacctccgaccctggtcctacgttcgactctacgcgggtccgtacgg

SEQ ID NO: 409378 - DNA, 586 bp, Homo sapiens
  misc_feature: GZ8MTXP02GKNKT.3.82.H05.1.454.CMB.2.raw
  modified_base (434)..(434): a, c, t, g, unknown or other
  modified_base (509)..(509): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctacccgaggggaacgggctgggagtgggtctctagttatttacaattctggtaccacgatacctactccgaccccgtagaacgggtccgaattaaccatcctaccagtaagaccgtagttcccgaagaaacnccgggttgtaactcttacgaaatcgaaaccaaaccgtgaagacgacccgacgacctaccgggtcgtttaactacncgtgcgaagtagtattcggagttcgggtccgggacctcgcccgttggtcctagttcggacttcgtcgtgggcctcgg

SEQ ID NO: 409379 - DNA, 631 bp, Homo sapiens
  misc_feature: GZ8MTXP02JFA45.3.82.H05.1.454.CMB.2.raw
  modified_base (297)..(297): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtttccagtgtgaggtgcaggtggtggagactggaggaggcttgatccagccgtggggggtccctgagactctcctgtgcagcctctggcttcaccgtcagtagcagctacatgcacgtgggtccnccgaggctccgaggggacggggctgggagtgggtctcgtagtttattacaattccgtaggtaccactactacctacctaccccggaccccgtggaaacggggtccgtaacttaacccattcctacccaagacgtaaccgtattacccggaagaaaccgtacggtcgttacttacttacaaaatcgaaaacctacctagacgtagacccgacgaccgaccggtcccgtttaataccgtggtacgacgagtacggtacgttcggaggttccggggttaccgggaccttcgacccgttgttacctaacgttcgacttcgtcgcggggccgtggtccc

SEQ ID NO: 409380 - DNA, 754 bp, Homo sapiens
  misc_feature: GZ8MTXP02IT5AU.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactgggaggaggcttgatccagccgtggggggtcctgagactctcctgtgcagcctctggcttcaccgtcagtagcagctacatgcacgtcgggtccgccgaggcctaccggagggggaacggggtcgtaggggaggttggggtcctacgtaaggtttaatttacctaaatttccgtacggtaacccaacgtaacttaacccgttaacccgtccccgggaacccccggttagggaaaaccgggggtacccgtaaacttaaaccgacttaccctacccgaagaacgtaacgtaacgttcccggaaagtaaaccgtaccgggttagttaaacttaccttaaacaaaacgttacgaaaaaccctaaccgtaggaacggaccggacccggaaaccgaacccggtaccgggttacccgtttttaagttaaccgttggtacggacgaacggtaagtacgtttcgggaacgggtttcggggttacccgggggtaccttaccgtcccggttaggtttaacctaccgtttacggacttcggtcggtcgggggtccgtccggg

SEQ ID NO: 409381 - DNA, 691 bp, Homo sapiens
  misc_feature: GZ8MTXP02H48WI.3.82.H05.1.454.CMB.2.raw
  modified_base (591)..(591): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctctgtgcagcctctggcttcacccgtcagtagcagctacatgccacgtcgggtccgccgaggcctaccggaggggaacggggcgtgggaggtgggtctcgtaagtttactttactaacgttcgtacggtaccactactaccgttaccctccccggaacccccggttaggaaaccggggtacccgtaaactttaaaccccgacttaccctacccgaaagaacggtaacccgtaacgttaccccggaagtaaaaccgtaccggggttattaacttaccgttaacaaaactacgaaacctaaaccgtaggaaacgacgacccgaacgaaccgtaccgggttaccgttttaanaccgttggtacgacgaagtacgtacgtttcggagttcggggttaccgggacctccgtacccgttggttcctacgttcgactcgtcggtcggggtcctcgg

SEQ ID NO: 409382 - DNA, 755 bp, Homo sapiens
  misc_feature: GZ8MTXP02FRIMO.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggtcttcgaccgtcagtagcagctacatgcacgtggtccgccgacggcctaccggaggggaacggggcgtaggggaggttggggtctacgtaggtttactttaactaactttcgtacggtacctacgtacttaccttaccgtccccgggaacccccgtagggaaaccggggtcccgtaaactttaaacccgacgttaccctacccgaaggtaaccggtaacgtaacgtttacccggaaagtaaaccgtaccgggggtttattaaactttaccgttaaacaaaaacgttacggtaaaaccctaaacccgttaggaaccggaacggaccccggtaaaccgaaaccgtaccgggtttaccgttttaacgttacgtggtacggaccgtaaggtaacgtacgtttcggtacgggttcggggttacccggggacccttaccgtacccggtttcggttaaccgtttacgttcggtactccgtcggtcgggggtccttaccggg

SEQ ID NO: 409383 - DNA, 666 bp, Homo sapiens
  misc_feature: GZ8MTXP02GM9V5.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtggtccgcaggctccgaggggagggctgggagtgggtctcgtagttatttacaacttcgtacggtaccactataccgtacctccccggaccccgtaggaaacggggcccgtaacgttaaccatcctacccagtaacgaccgtaacgttcccggaaagtaaaccgaccgggttattaacgttaccttaacgaaaagttacgaaaaccctaaaccgtaggaacgaacggcccggaaacgaaccgtaccgggttaccttttaataaccgtggtacgacggtaagtaacgtacgtttcggaacggttcggggtaccggggaccttaccgacccgtttggtaaccttacgttacgacttccgtcggtcgggggtccgtccgg

SEQ ID NO: 409384 - DNA, 740 bp, Homo sapiens
  misc_feature: GZ8MTXP02IL4TO.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtcctgagactctcctgtgcagcctctggcttcaccgtcagtagcagctacatgcacgtgggtccgccgaggccgtaccgaggggaaggggcgtaggggaggttcggggtctacgtagtttaactttactaactttcgtacggtacctacgtacttacccttacctccccggtaccccgttaggaaccggggtacccgtaacgttaaccacttccaccgaagaacggacgtaacttaccggaaagaaacgtacgggttatacgttaccttaacaaatacgaaacctaaccgtaggaacggacgtacccggaaaccgaaccgtaccgggttaccgtttttaacttaacggttcgttacggacggtaagtaacggttacgtttacggggtaacgggtttcgggggttaaccccgggggtacccttacccggttacccgtttacggtttaacccgtttaaaccgttccggtaactttccggttaccgggttccgggggtacccggtttcccgg

SEQ ID NO: 409385 - DNA, 565 bp, Homo sapiens
  misc_feature: GZ8MTXP02JF9WA.3.82.H05.1.454.CMB.2.raw
  modified_base (430)..(430): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccgccaggctccgaggggacggggctgggagtgggtctctagtttaattacaacttatggtaccacactacctactcccggaccccgtggaacggccgattaaccatcctaccgagagacgattccgaagaacacggtntactctacgaatacgaaacacgtacgagacgaccgacacgacggtcctttatactggtcgacgagagagttcgaggttcggtacgggacctccgacgtacgttcgtctttacggacttcctcggtcgggtcgtcg

SEQ ID NO: 409386 - DNA, 611 bp, Homo sapiens
  misc_feature: GZ8MTXP02IN8AB.3.82.H05.1.454.CMB.2.raw
  modified_base (368)..(368): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttggtcgggcgactcggtacggttttaacagtagttggttagtcgtggtatcagcaagaaaccgagggaaacgcccccgtgagttcctgatgtctgctgcactcccacctgacgtaaagtcggtacgtcccactaccagtacttcagtcgtacngtagaatcgtagggactagtacgttccacttcaccacatcgagcagtccctgccacgtaccgtagaagttactttcgtaacttaacgtttacttaattcgtaacaacgtacggtactagacgtacgttccctcccgtacttaccgtaccggttttaccgggacggggttaccggaaaccggtaaaggggttacggaaacgtaacgtaaccgtaaaacggtaacgtcggttacggtaccgtacg

SEQ ID NO: 409387 - DNA, 826 bp, Homo sapiens
  misc_feature: GZ8MTXP02GUG2X.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgcccgaggcctaccggaggggaacgggggtctaggggacggttggggtacctacgtaaggtttaattttaaaccaacgtttccgtagggttaaaccccaactaactttaaacccttaacccgttcccccgggtaaccccccggttaggaaaaccgggggtccccgtaaactttaaaaccccagttacccttacccgaaaggaaacggtaaccgtaacgtttaccccggaaaagtaaacccgtaaccggggtttgttaaacgttcctttaaaccaaaaaagtttacggaaaaccctaaaacccggttggaaacgggaacggtaccccggaaaccggtaacccgaaccggggttacccttttaaagttaacccgtaggttaggaccggtagtaaacggtacgttttaccggaggggttacggggtttcccgggggaaaacccttccgtaaaccccggttttcgggttaaccgtttaacccgtttacggtaaacgttcccggtttaccggtcggggggtaacccggttccgggg

SEQ ID NO: 409388 - DNA, 688 bp, Homo sapiens
  misc_feature: GZ8MTXP02JAE4I.3.82.H05.1.454.CMB.2.raw
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttggtcgggcgacgtcggtacggttttaacagtagttggttagtctggtatcagcaagaaaccgaagggaaacgccccgtagacgtttcctgatgtctgctgcactcccacctgacaaagtcggacgtcccactaccgagtactacacggtcgtacaggtagtaagtcgtagggactagtacgttccacgtcctaccacctactacgagacctacgccgtcgaccgacgtacccgttaaggaaacgtttacgtttttaacggaccctttaaaaccttttacgttaaacgtttacgtaaacccgtaaacggacgggtaccttacggaccgtaaccgttcccccgtacccgtaccgttacccgtaccgggtttaccggggaccgggggtaaaaccggggtaacccgtaagggggtaacggaacggtaaacgttaaacccggaaaacggttacggtacgggttacgggacctaccgg

SEQ ID NO: 409389 - DNA, 637 bp, Homo sapiens
  misc_feature: GZ8MTXP02GHPUI.3.82.H05.1.454.CMB.2.raw
  modified_base (277)..(277): a, c, t, g, unknown or other
  modified_base (426)..(426): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcttgggttttccttgttgcttatttacaaaaggtgtccagtgtgaggtgcaggtggtggagacgtggaggagcttgatccagcgtgggggtcctgagactctcctgtgcgacgcctcgtggtcttaccgaccgtnagtagcagctacatcgaccacggtcggccgaccgacggcctaccggaaggggaacgggtcgtagggaggtcgggtcctagtaagttaattactattcgtacgtacactactactaccgtcccgaccgtaggaacggacctacttaaacnctccacgaagtacgacctataccgaaagtaacgtcggttataactctaaacaaatacgaaaccacgtagagaccgaccggaataaccgcgggttacctttagtcgtgacgagagtatacggttcgagggttaccgggtccggaccctaaccgtcccggtttgtaacctttaaccgtcgtacgttccggtacggtcccgggggtcctaccgg

SEQ ID NO: 409390 - DNA, 692 bp, Homo sapiens
  misc_feature: GZ8MTXP02FT1NJ.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctattcaaaggtgtccagtgtgaggtgcaggtggtggagacgtggaggaggcttgatccagccgtgggggtccctgagactctcctgtgcagcctctggcttcaccgtcagtagcagctacatgcacgtcgggtcccgccgacggcctaccggaagggggtaacggggcgtggggaggtcggggtctcgtaagtttaactttaactaacgtttccgtacggtaacccaactaacttaacccttaacccgtcccggaaccccggtaggaaacggggacccgtaacttaaccactaccctaccgagacgaacgtacgttacccggaagtaaaccgcggggttattaacttcgttaacaaagttacgaaacctaaccgtagaacgacgacccggaacgaaccgtaccggttaccgttttaatacgtggtacgacgaagtacgtcgtttacggacgggtttcggggttaccgggacccttacgtacccgttaggttccttacgtacgtacttccgtacggtcgggggtccctacgg

SEQ ID NO: 409391 - DNA, 667 bp, Homo sapiens
  misc_feature: GZ8MTXP02HXOZW.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagactggaggaggcttgatccagccgtggggggtccctggagactctcctgtgcagcctcgtggcttcaccgtcagtagcagctacatgcacgtcgggcccgccgaggctaccggaggggaaggggcgtgggagtgggtctcgtagtttactttacgtaatttcgtaggtacctaacactacctaccgtacccgacccccgtagaaccgggtaccgaacttaaacccatcctaccgagaacgacgtacttaccggaagtaacgacggtagtactacttaacaaatcgaaacctaaccgtagacgacgaccgaacgaccgtaccgggttacctttaacgtacgtacgtacgacgtaagacggtacttacgggacggtttacgggggttacccggggtaaaccctcccgtaacccgtttcgggttaccctttacgttacccggtactttccggttaccgggtccggggg

SEQ ID NO: 409392 - DNA, 563 bp, Homo sapiens
  misc_feature: GZ8MTXP02GXUYY.3.82.H05.1.454.CMB.2.raw
  modified_base (415)..(415): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccgccaggctccgaggggaaggggctgggagtgggtctcgagttatttacaattctggtacacatactactccgacccgtgaacggcgattaccatctaccagagacatccgagaacncggtagactcttacaaatcgaactaacctgacgacgaccgaacgaccgacggtacctttataccgtgtagacgagagtagttacggagttcggttaccgggggaacctcgaaccgttcggttactactacggtactcgtcgtcggggg

SEQ ID NO: 409393 - DNA, 541 bp, Homo sapiens
  misc_feature: GZ8MTXP02FGCWY.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcacgtgggtccgccaggctccgaggggaaggggctgggagtggggtctcagttatttacaattctggtaccacatactactccgaccccgtgaagggccattaaccatctaccagagacgattccgagaacacgtgtatcttacaaatgaaacacctgagagccgacgaccacggtccgtttatactgtgacgagagagttcgagtgggttacgggacctcgacccttggtctacttcgatctcgtggggcctcgg

SEQ ID NO: 409394 - DNA, 580 bp, Homo sapiens
  misc_feature: GZ8MTXP02H01J5.3.82.H05.1.454.CMB.2.raw
  modified_base (369)..(369): a, c, t, g, unknown or other
  modified_base (440)..(440): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagacgtggaggaggcttgatccgagccgtgggggtccctgagactctcctgtgcagcctctcggcttccaccgtcagtagcagctacatgcacgtgggccgccaggcctccggaggggaaggggctgggagtgggtctacgtagttactttacaattcgtaggtaccanatcctaccgtccgaccccgtagaacgccgaattaaccatccacagacgacgacttaccgaagacgacggtntagtactacaaatacgaaactaccgtagagacgacgacgactacggtacttatacgtgagcgaagtgactacgtaggtcgggttaccgggccttacgcccgttggttaccttacgttcggacttccgttacggtccgggg

SEQ ID NO: 409395 - DNA, 839 bp, Homo sapiens
  misc_feature: GZ8MTXP02ITVUB.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtgggtggagacgtgggaggaggcttgatccagccgtgggggtcctgagactctcctgtgcagcctctggcttcaccgtcagtagcagctacatcgcacgtcgggtccgccgaggcctaccggaggggaacggggcgtggggaggttgggtctacgtagtttaactttacgtaacgtttccgtacggttaacccaacgtaacttaaccttaaccccgtcccgggtaacccccggttagggaaaccgggggtaccccgttaaacttaaaacccgtacttaccctaacccgaaggtaaccggtaacgtaacgtttacccgggaaaggtaaaaccgtccggggtttagttaactttaccttaaacgaaaacgttacgtaaaaaccccgtaaacccgtaaggggtaaccgaacccgggtaccccgaaaacccggtaacccggtaacgggggtttaacccctttttaagttaaccggttgggttaacgggacgtaaagggtaacgggttacgttttaccggggaacggggtttccgggggtttaacccgggggtacccttacccggtacccccgttttaggggtttaacccttaaccgtttaccggtaccgtttccggttccgggggttccgggggtaccggtttccccggg

SEQ ID NO: 409396 - DNA, 587 bp, Homo sapiens
  misc_feature: GZ8MTXP02GATFO.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgaggggaagggctgggagtggggtctcgtagtttactttacaattcgtagtacactatacctactccgacccgtgaacggcctataaccatcctaccgagacgacgtagttccgaagaacgaggtcgtatctacaaatacgaaacacgtgacgacgaccgacacgacggtctttatacgtgagtacgaagtagtacttcggacggttcgggtaccgggaacctccgtacccgtttggttaaccttaccgttacgacttccgtcggtcggggcccgttcggg

SEQ ID NO: 409397 - DNA, 757 bp, Homo sapiens
  misc_feature: GZ8MTXP02ISTZ0.3.82.H05.1.454.CMB.2.raw
  modified_base (274)..(274): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctggccttcaccgtnagtagcagctacatcgcacgtcgggtcccgacgacggcctaccggaaggggaacgggggcgtgggacggttcggggtcctacgtaggtttaactttaccgtaatttccgtacgggtaaccctactaacttaccgtacccgttacccccggaacccccgggttaggaaaccgggggtacccgtaaactttaaacccacgttccctacccgaaggtaaaccgaccggtaactttacccggaaacggtaaaaccgtacgggtttacgttaaacttcctttaaacgaaaacgttaacggaaaacctaaccgtagaacggaccgacccgacgaaaccgtccgggttaccctttaagtaccgtggtacgtacggaacgtagtacggtttacggaacgggtttcgggggtttacccgggaacctttcccgtaaccccggtttaggtttcccgttaaccgttcggtacctttcggtcccggttaccggggg

SEQ ID NO: 409398 - DNA, 684 bp, Homo sapiens
  misc_feature: GZ8MTXP02HZSWN.3.82.H05.1.454.CMB.2.raw
  modified_base (251)..(251): a, c, t, g, unknown or other
  modified_base (502)..(502): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcngcctctggccttcaccgtcagtagcagctacatgcacgtcgggtccgccaggcctccggaggggaacggggcgtgggaggtgggtctacgtagtttacttaacaactttcgtacggtacccactacttaaccttacctcccggtaaccccgttaggaaaccggggtaccgtaacttaacccgacttcccaccgaagacgaccgtacgttacccgaagtaaacccgtgggtacttaactacccgtttaaaanaaaacgtacgaaaacctacgtaggaacgaccggacccgaacgtaacgtaccggttactttaagtcgtgtacggacgtaaggtacgtacggttaggacgggttcggggtacccggtaccctccgtacccgtttcggttaaccttaccgttcgtacgtccggtccgggtccggggtcccgacgg

SEQ ID NO: 409399 - DNA, 794 bp, Homo sapiens
  misc_feature: GZ8MTXP02JX9ST.3.82.H05.1.454.CMB.2.raw
  modified_base (517)..(517): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctctgtgcagcctctggcttcaccgtcagtagcagctacatgcacgtgggtcccgcgaggccgtccgaggggacggggctgggagtgggtctacgtagtttactttacgaactttcgtaggtacccaacgtactaccgttacccgtccccggtaacccccggtaggaaaccggggtacccgtaaactttaaaaccccgacttacccgtacccaaagggtaaacggtacccggtaaacctttaccccgggaaagtaaaacccgttacccgggggttnttaaaccgttcctttaacaaaaacgttcgggaaaacctaaacccgtggaaacggaccggacccgggaaccgaccgtaacccgggggttccttttaaacgttaccgtggttaccggtaacggaaggtaacggtaacggtttcgggaacggggtttaccgggggtttcccgggggaaacccctttcccggtaaacccccggttttgggttaaacccgttcccgtttaacggtacgtttcccggtaccgggggttaccgggggtcccggttaacccgggg

SEQ ID NO: 409400 - DNA, 721 bp, Homo sapiens
  misc_feature: GZ8MTXP02G4EKO.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttgactgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccgccgaggcctccgaggggaacggggcgtgggaggtggggtctcgtagtttatttacaatttcgtaggtacccacgtacttaccttaccgtccccggaccccgtaggaaacggggaccctaacgttaaacccagttaccctacccgaggaacgtaaccgtacgtttacccggaaagtaaaccgtacgggttagttaacttacgttaaccgaaaagttaacgaaacccgtaaaccgttaggaacggaaccggaccccgggaacgtaacccgtaccggggttacccgttttaataccgtggttacgggaccgtaagggtaacgtaccgtttggtacggggtttaccggggttcccggggaaccctccgtaaccccggtttggttaaccttacgttacgtacgtcgttccggtcgggggtacccgtcgg

SEQ ID NO: 409401 - DNA, 703 bp, Homo sapiens
  misc_feature: GZ8MTXP02FOVA7.3.82.H05.1.454.CMB.2.raw
  modified_base (305)..(305): a, c, t, g, unknown or other
  modified_base (482)..(482): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtgggaggaggcttgatccaggccgtggggggtccctgagactctcctgtgcacgcctcgtggcttcaccgtcagtagcagctacatcgcacgtcgggccnccgaggcctaccggaaggggaacggggcgtgggaggtgggtctcgtagtttacttacaactttcgtagtaccactactaaccgtacctcccggacccgtagggaaacgggtaccgtaattaaaccgatacctaccgagtaacggtaaccgtactaccggaaacgtaacgacgggttnttaacttactaaactaacgtaaacgaaaccacggtaggacgaacgacccggaacgtaaccgtaccggttactttagtacgcggtacgcgtaaaggtagtaccggtttagggttacggggttaccgggggttacccggggaaccctttaccggtacccggttttggttaacccttacggttacgtaccgttccggtcggggtcccgggggtccgttacccgg

SEQ ID NO: 409402 - DNA, 605 bp, Homo sapiens
  misc_feature: GZ8MTXP02IXQCM.3.82.H05.1.454.CMB.2.raw
  modified_base (438)..(438): a, c, t, g, unknown or other
  modified_base (525)..(525): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagccgctggcttcaccgtcagtagcagctacatgcacgtcgggtcccgcccaggcctaccgaggggaagggcgtggagtggggtctcgtagtttacttacaattctacggtaccactactacctacctcccgacccgtgaacgggcacttaaccatcctccagacgacgtattaccgagaaaccncgggttatactcgttaacaaaattcgaaacctaaccgtggaacgacgacccgaacgacgtacggtacgtttatacgtgtgaccgganaggtacttcgggaggttcggggttaaccgggccctacgtaacccgttggttcctaacgttgaccttcgttcggtacgggg

SEQ ID NO: 409403 - DNA, 669 bp, Homo sapiens
  misc_feature: GZ8MTXP02IUQIY.3.82.H05.1.454.CMB.2.raw
  modified_base (489)..(489): a, c, t, g, unknown or other
  modified_base (545)..(545): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctcgtggcttcaccgtcagtagcagctacatgctacgtcgggtccgccgaggcctccggaggggaacggggctagggaggttggggtctacgtaggttaatttactaagttcgtacggtaccaactacttacccttaaccgtccccggtaacccccgtaggaaaccggggtcccgtaactttaaaccgacttcctaccgaagtacgacgtaactcccgaagaaacgtaccgggtntaactcttacaaattcgaaacctactgaagacgccgaacgacgtacggtactttanacttgagacgagtacgtattcgggacgttcggggtttacccggggaaccttccgtaaccccgtttgggttaaccttaccgttacggtaaccttccgtcggttcccgggggtcccgtttaccggg

SEQ ID NO: 409404 - DNA, 712 bp, Homo sapiens
  misc_feature: GZ8MTXP02FUTUV.3.82.H05.1.454.CMB.2.raw
  modified_base (256)..(256): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgcttatttacaaaaggtgtccagtgtgaggtgcaggtggtggagacgtgggaggaggcttgatccgaggccgtgggggtcctgagactctcctgtncagcctctggcttcaccgtcagtagcagctacatgcacgtcgggtcccgcgaggcctccggaaggggagggcgtgggaggtgggtctacgtagtttaactttactaacgtttcgtacggtaacctacgtaacttaaccttacccgtccccgggaacccgtagggaaacgggtacccgtaaacttaacctactacctaccgaaggtaacgtacgtaacgttaccggaaagtaaaccgtacggttacttacttaccttaacaaaacgtaacgaaaacctaaccgtaggaacgacggacccgtaacgacccgtacggttaccgttttaatacgtgtacggacgagtaaaggttacgttacgggtaaggttccggggttaccggggtaccccttacgttacccggtttggttaaccttaaccggttacgtacgttccgttcggggcggggttccgtccgg

SEQ ID NO: 409405 - DNA, 759 bp, Homo sapiens
  misc_feature: GZ8MTXP02H7F22.3.82.H05.1.454.CMB.2.raw
  modified_base (259)..(259): a, c, t, g, unknown or other
  modified_base (374)..(374): a, c, t, g, unknown or other
  modified_base (424)..(424): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccgagccgtgggggtccctgagtactctcctgtgcagcctcnggccttcaccgtcagtacgcagctacatgccacgtcgggtcccgccgaggcctaccggaggggtaaggggttggaggtgggtctcgtagtttattactattcccgtaggtaccanacttactacgtcccccgacccgtaggaaacggaccgttaacgttaaaccncgtacctacccgagtaaacgacgtaacgttcccggaaacggaacctacgggttacgttaacttaccgttaaccaaaagttacgaaaacctaccgtacggaacggaagaccccggaaaccggtacgtaacccggggttaccgttttaactacgttggttacgacggaacggtaacggttacttaccggggtagggtttaccgggttacccgggggacccttacccggttaacccccgtttggggtttaaccccgttaacccggtttccggtaaccgtttcccgggttacccggggtttaccccgggggtacccggtttcccggttaaccccccggg

SEQ ID NO: 409406 - DNA, 708 bp, Homo sapiens
  misc_feature: GZ8MTXP02FTS4H.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcacgcctcgtggcttcaccgtcagtagcagctacatgcacgtcgggtccgccgaggcctaccggaggggaacggggtcgtaggggtaggtcgggtctacgtaggtttaactttaacaatttcgtacggtaaccaactacttacctaccgtccccggaaccccggtaggaaccgggtaccgtaaacttaaacccactccctacccgaaggaacgtaccgtaacttacccggaaagtaaaccgtacgggttataacttacctttaaacgaaaactacgaaaaccctaaccgtaggaaacgggaaccgaccccggaacgtaaccggtaacccgggtttaccgtttaattaaccggtggtacgacggaaggtagtacgttacgggacggttccggggttaccgggtaccctccgtaacccgttcggttacctacgttcgacttccgtcggttcccgggg

SEQ ID NO: 409407 - DNA, 655 bp, Homo sapiens
  misc_feature: GZ8MTXP02GZDVB.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtggaggaggcttgatccgagccgtgggggtccctgagactctcctgtgcagcctctggccttcaccgtcagtagcagctacatcgcgacgtcgggtcccgccgacggcctaccggaaggggaacggggtcgtaggggaggtcgggtctacgtagtttatttactaactttcgtacgtaccactactacctaccgtcccgacccgtaggaaccgggtacctaacttaaccactacctaccgaagaacgacgtacgttacccgaaagtaacgtaccgggtattaactaccttaacaaaagtacgaaacctaaccgtgaacgacgaccgaacgaccgtacgtaccgtttaatacgtgtagacgaagtacgtacgttcggacggttcggggtccggaaccctccgtacccgttggttaacctacgtcgtacgtccgtcggtcggggtctaccgg

SEQ ID NO: 409408 - DNA, 650 bp, Homo sapiens
  misc_feature: GZ8MTXP02GQVT0.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctcgtggcttcaccgtcagtagtcagctacatcgcacgtcgggtccgccgaggcctccggaaggggaaggggctggggaggtggggtctacgtagtttacttactaacgttcgtaggtaccactattacctaccgtcccggaccccgtaggaaacggggccgtaacttaaccatcctaccgagacgtacgactcccgaagaaccgcggtatactcttaaacaaattacggaaacctaactggaacgacggacccgaacgacgaccggtaccgttttaataccgtggtacggcgtaaaggaggtactttcggggacggttcggggttaccggggaccctacgtaaccccgttggttaacctaccgtttcgacgttccgtcggttcgggggccctcggg

SEQ ID NO: 409409 - DNA, 584 bp, Homo sapiens
  misc_feature: GZ8MTXP02FSWKU.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactgggtccgccaggctccgaggggaaggggctgggagtgggtctcgagtttatttacaactttcgtggtaccactatacctacctcccgaccccgtggaacgggccgaattaaccatcctaccagtacgacgtacttccgaagaacacggttgtaatcttacaaatcgaaacaacctgacgacgaccgagaccgacggtaccgtttatacgtgtacgcgagacgtattcggaggttcgggttccggggaccttacgacccgttggttcctacgttcgactcgtcggtcggggcctcgg

SEQ ID NO: 409410 - DNA, 725 bp, Homo sapiens
  misc_feature: GZ8MTXP02H8YH4.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaggtgtccagtgtgaggtgcaggtgtggagactgggaggaggcttgatccaggccgtgggggtccctgagactctctgtgcagcctctggcttcaccgtcagtacgcagactacatcgccacgtcgggtcccgcgacggccgtaccggaaggggaacggggtcgtaggggacggttcgggtcttacgtaagttttaactttactaactttcgtacggtaccactacttaccgttaacccgtcccgaaccccgttaggaaaccgggtaccgtaacgttaaaccgatccctaccgaagacgtacgtacgttaccgaaagtaacgtacgggtattaactacttacaaaactacgtaaacctaacgtaggaacggacgacccggaacgtacccgtaacggttaccgttttaaacgttcgttacggtttaacgacggtaagttaacggtacggttacggggttcgggttaacccgggaccttacccgttacccgtttcggggtttaccctaacggtttaccggactttccggtaccggtccgggggtacccgttcggccccg

SEQ ID NO: 409411 - DNA, 766 bp, Homo sapiens
  misc_feature: GZ8MTXP02I7T8T.3.82.H05.1.454.CMB.2.raw
  modified_base (563)..(563): a, c, t, g, unknown or other
  modified_base (649)..(649): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccgagtccgtcgggggtcctgagactctcctgtgcagcctcgtgtctcaccgtcagtacgcagactacatcgacacggtcggtcccgccgacggtaccgtccggaagggggaacggggcgtaggggtacggtcgggttaccttacgttaagtttaacgttttaacctaacgttttccgtaccggttaaccaacttaacttaacccgttacccgtcccccgggtacccggtaacgggtaaacgggtacccgtaaacgtttaaaccactttcccgaccgtaaagaccgtaacgttaaccgttaccggaaacgtaaacgtacgggttattaacctttaccttaaanaaaacgtacggtaaaaccctaccggttaggaaacgaccgggacccgtaaaccggtaaccgtccggtttaaccttttaagtaccggngtacggacgtaggtaacgtcgttacggggtagttccgggggttaacccggtcctaccgtaccggttttaggtaacccgttactcggtaccttcggtacgggtccggggtaccgtcgg

SEQ ID NO: 409412 - DNA, 733 bp, Homo sapiens
  misc_feature: GZ8MTXP02FG1UM.3.82.H05.1.454.CMB.2.raw
  modified_base (288)..(288): a, c, t, g, unknown or other
  modified_base (545)..(545): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccggtgggggtccctgagactctcctgtgcacgcctcgtggtcttccaccgtcagtagcagcctanatgcacgtcgggtccgccgaggctccggaaggggaacggggcgtgggacggtggggttcctcgaggttttaactttaacgtaactttcgtacggtacctaactaacttaaccttaccgttcccccggacccccggttaggaaaccgggggtccctaaactttaaacccattccctacccgaaggtaacggaacgtacttacccggaagtaaacccgagggttacgtaacttcttaacaaaatacgaaacctaaaccnggaacgaccggacccgaaacgaacccggaccggtttacccgttttaaacgttaccgtaggtacggtaccgtaaaggtagtaacggtttccggtaagggtttcgggggttacccggggacccttacccgacccgtttggttaaccttacgttaccgtacgttcccgttacgggtccggggtccgtccgg

SEQ ID NO: 409413 - DNA, 582 bp, Homo sapiens
  misc_feature: GZ8MTXP02GYP8A.3.82.H05.1.454.CMB.2.raw
  modified_base (300)..(300): a, c, t, g, unknown or other
  modified_base (372)..(372): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccnccaggctccgaggggaggggctggaggtgggtctcgtagtttacttactaattctaggtaccacatcctacnccgacccgtagacggacactaccatctacagagacgattccgaagacacgggtatactacttacaaagtagaaacctaccgtagacggacgaccgacgacgaccggttacgttacttaacgtgtagcgagagtaacgtcggaggttacggggtccggggaaccctcgtaaccccggttgttaccgtacttccggtactctcgggtcgggg

SEQ ID NO: 409414 - DNA, 696 bp, Homo sapiens
  misc_feature: GZ8MTXP02G6LDJ.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctcgtgcttccaccgtcagtagcagctacatgcacgtcggtccgccgaggccgtaccggaaggggaacggggcgtagggtaggttcggggtcttacgtaggtttaatttaactaacgtttcgtacggtaacccaacgttacttaaccgttaccgtcccccggtacccccgtagggaaaccgggtacccgtaaactttaaacccgacttaccctaccgaaggacgtaacgtacgttaaccgaagaaaccgtacgggtacttactactaactaaaagttacgaaacctaaccgtagaacgacgaccgaacgaacgtaccggtaccgtttaatacgttgacgcgtaagtacgtagttacggacggttcgggttaccggggtacccttaccgtacccgtttggttaacctacgttaccgtcgtccgtcggtcggggtcccgtacgg

SEQ ID NO: 409415 - DNA, 800 bp, Homo sapiens
  misc_feature: GZ8MTXP02G6806.3.82.H05.1.454.CMB.2.raw
  modified_base (302)..(302): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagggtggtggagactgggaggaggcttgatccagccgtgggggtccctgagactctcctgtgcagcctcgtggccttcaccgtcagtagcagctacatgcacgtcgggtccncgaggcctaccggaaggggaaggggcgtagggaggtgggtctcgtaagtttatttaacaactttcgtacggtaacccaacgtacttaaccgtaacccgttcccccggtaacccccgggttagggaaaacccgggggtaccccgtaaacttttaaaccccaacgttaccctacccgaaggaaacggtaaccgtacgtttaccccggaaagtaaaacccgacggggtttataactttaccttaacgtaaaaacgttacggaaaacccaaacccgttagggaaacggtaccgggaccccgggaaaccgtaacccgaaccggggtttacccggtttttaaactaacccgttgggttaacggacggtaaggaacgttaacggtttcgggaaagggttccgggggtttaacccgggggaacccttcccggtaaaccccgtttggggtttaacccttacggtttccgtacgttccgttaccggtcggggggtccctttaccgggg

SEQ ID NO: 409416 - DNA, 820 bp, Homo sapiens
  misc_feature: GZ8MTXP02IQ47Z.3.82.H05.1.454.CMB.2.raw
  modified_base (258)..(258): a, c, t, g, unknown or other
  modified_base (273)..(273): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtgggtggagacgtgggagggaggcttgatccagccgtggggggtccctgagactctcctgtgcncgcctctggcttccnccgtcagtagcagctacatgccacgtcgggtcccgccgacggcctaccggagggggaacgggggtccgttggggacgggttggggttccttacgttacggttttaaacttttaaccgtaaacgttttccgttacgggtaaccccctaacgtaactttaacccgttaacccgttcccccgggtaacccccggttaggggaaacccgggggtaccccgttaaaccgtttaaaccctaaacgttcccgtaacccgaggaaaccggtaccgtaacgtttacccgaaagaaaccgtacggggttatacgttaccttaacaaattacgaaaaccctaacgtacggtaaggaccgaccgggaaaccgtaaccgtccgggtttacccttttagtaccgttggtcgaacggtaggtaaacgtcggtttacgggtaggggtttccgggttaccgggggaacccctttcccggtacccgttttacggggtttaacccttaccggtttacggttacttccgggtttaccgggttcggggggtaccccgtttcccggggg

SEQ ID NO: 409417 - DNA, 665 bp, Homo sapiens
  misc_feature: GZ8MTXP02HJMPP.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctcgtggtcttcaccgtcagtagcagctacatgcacgtcggggtcccgccgaggccgtaccggaaggggaacggggcgtaggggaggtcggtctacgtaagtttactttacgaactttcgtagtacccactaactaccctaccgtccccggtaccccgtaggaaccgggtaccgtaacttaaacccacttaccgtaccgaagaaccggtaacgtacgttacccggaaagtaaaccgtcgggttattaactcttaaacgaaatcggaaaaccacgtgaacgacgacccgaaacgaccgtaccggttactttaagttacgtcggtgaacgagtaagtacgttcggaggttcggggttaccgaccttacgtacccgttgttccttcgtacgtctcgtcggtacggggtctccgg

SEQ ID NO: 409418 - DNA, 658 bp, Homo sapiens
  misc_feature: GZ8MTXP02IF4K5.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccaggccgtgggggtccctgagactctcctgtgcagcctctggcttcaccgtcagtagcagctacatgcacgtcgggtcccgccgacggcctccgaggggaacggggctgggaggtggggtctcgtaagtttatttacaacttcgtaggtacccatactacctaccgtcccgacccccgtaggaaacgggaccctaacttaaccacttcctaccaagtacgaccgtacgttacccggaaagaaccgtacggtagttaactaccttaacgaaaactagaaaaccaaaccttggaaagaccggacccggaacgaaccgaccgggttaccgttttaattacgtgtacgtacgaagtacgtagtttcggaggttcggggttccgggacctccggtacccgttgttaaccgtacgttcgtatcccgttgtcggttacgggtccccg

SEQ ID NO: 409419 - DNA, 713 bp, Homo sapiens
  misc_feature: GZ8MTXP02HMEFT.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctggcttcaccgtcagtagcagctacatcgcacgtcggggtccgccgaggcctccggaggggaaggggcgtgggaggttggggtctacgtagtttaactttacaacgtttcgtacggtaccactattaccctactccccggtaccccgtggaaacgggcccgtaaacttaaaccgattcctacccgaagaacgaacgtacttacccggaagaaaaccgtacggggttataactttaccttaaacaaaacgttacggaaaacctaaacccgttaggaaacggacgaccccgggaacgaaaccgtaccgggttaccgtttttaactaccgtaggtaggccgtaaaggtaggtaagtttccggaagggtttcggggttaccggggaccccttaccgtacccccgtttgggttaacccttaccgtttacgacttccgttccgggtcgggggtccctcgggg

SEQ ID NO: 409420 - DNA, 720 bp, Homo sapiens
  misc_feature: GZ8MTXP02F52MN.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcacgcctcgtggcttcgaccgtcagtagcagctacatgccacgtcggtccgccgaggctaccggaggggaggggtctgggagtgggtctcgtagtttatttacaacttcgtacggtaaccacgtacttaacctacccgtcccggtaaccccggtagggaaaccggggtacccgtaaattaaacccgacttacccgttacccgaaaggttaaccgaacccgttaacttacccggaaagtaaaccgtacgggttagttaacttccgtttaaacaaaacgttacgaaaacctaaaccgtaggaacgacggaacccgacgaacccgtacggttacctttagtaccgtggtacgaccgggtaagacgttacgttacggtaacgggttcggggttacccgggtaccctcccgttacccgtttggttaacccttaccgttacgtacgttccgtccggggtcggggtcccgttccgg

SEQ ID NO: 409421 - DNA, 683 bp, Homo sapiens
  misc_feature: GZ8MTXP02FQIMJ.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccgagccgtgggggtccctgagactctcctgtgcagcctcgtggcttcaccgtcagtagcagctacatgccacgtcgggtccgccaggctccgaggggaaggggctgggagtggggtctcgtagtttatttacaatttcgtcggtacccactagttacctacgtccccggaccccggttagaacggggaccgaaactttaacccacttcctcccgaagacgaacgtacgttacccgaacgaacgtaccggtgttaactctttacaaaattacgaaactaacccgtagaacggacggacccgaacggaaccgtaccgggttaccgtttaattaaccgttggtacgacggtaacggaagttacgttaccggtacgggttacggggttcccggggtaccgttacccgtaaccccgtttcggtttaccgttaccgtttccgtaacttccgttacggtttcccggggg

SEQ ID NO: 409422 - DNA, 714 bp, Homo sapiens
  misc_feature: GZ8MTXP02HX39D.3.82.H05.1.454.CMB.2.raw
  modified_base (562)..(562): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcgtgggttttccttgttgctatttcaaaaggtgtccagtgtgaggtgcaggtggtggagactggaggaggcttgatcagccgtgggggtccctgagactctcctgtgcagcctctggctcaccgtcagtagcagctacagtcgcgtaccgtcgggtcccgccgtaacgggcctacccgggaaggggaaacggggtccgttaggggaacgggttcggggttacctaccgttaagtttaactttaacgaaacgttttccgtacgggtaccctaacgtaacttaccttacccgtacccccgtacccccggtacggaaacggggtcccgtaaactttaaaccccattacccgtaacccgaggaacgtaaccgtacgtttacccggaaagtaacgaccggttagtattaccgtaactaaaanacgaaactacgagacgacgaaccgacgacgtacggttactttagtacgtgagacggtaagtagtacgttacgggtacggttaccggggttacccgaccgttaccgtaacccggttcgttaccttaccgtgtaccgttcggttaccggtcggg

SEQ ID NO: 409423 - DNA, 603 bp, Homo sapiens
  misc_feature: GZ8MTXP02JG09T.3.82.H05.1.454.CMB.2.raw
  modified_base (299)..(299): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgtacttggtcgggcgactcgtcggttttaacagtatggttagtctggtatcagcaagaaaccgagggaaacgcccctagacgtttccngatgtctgctgcactcccacctgacaaagtcggacgtcccatccagtacttcgagcgtcaggtgaaatcggtagggactagtacgttcaccttcaccaccatcaagtcacgctgcagcctagtaagttatttacgacctaacgtttacttattacgaacaacgtcggtactacgtacgtaccgtcccgttacccgtcttaccggttaacccggtttcgggggaccggggtaacggggtaaccggtaaggggtacggaacggtaacgtaaccgaaaacgggtacgtcggtacgggtacctaccgg

SEQ ID NO: 409424 - DNA, 769 bp, Homo sapiens
  misc_feature: GZ8MTXP02JSXUK.3.82.H05.1.454.CMB.2.raw
  modified_base (284)..(284): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaggtgtccagtgtgaggtgcgaggtggtggagactggaggaggcttgatccagccgtgggggtccctgagactctcctgtgcagcctctggcttcaccgtcagtagcagctanatgcacgtcgggtcccgccgacggcctccggaagggggaacggggtcgtagggtacggtcggggttcctacgtaagtttaacttttaacgaagtttcgtacggttaacccacgtaacttacccttacccgtacccccggtaacccccggttaggggaaaccggggtacccgtaaacgtttaaacccccgtaagttacccgttacccgaaagggaacggtaaccggtaacgtttacccggaaacgtaaaaccgtacggggtttacgtaacttaccgtttaaacaaaagttaccggtaaaacctaacccgttagaacggtaccggacccgaaccggaaccgtaccggggtaccttttagttacgtggtacgtaccggaggtaaggtacgttacggtaacggttcggggttacccggggtaccctacccgtaacccggtttcggtttacccttacggttacgtacggttccgtttacggtcccggggg

SEQ ID NO: 409425 - DNA, 609 bp, Homo sapiens
  misc_feature: GZ8MTXP02HF6LK.3.82.H05.1.454.CMB.2.raw
  modified_base (285)..(285): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctaacgntcgctacgtcggtccgcgacggccgtacggaggggacgggcgtagggaggtggtctagtagttattactacttcgtacgtaccactactacctaccgtcccgacccgtaggaaccggacctaactaccactccacgagacgacgtacgtaccgaagtacgtacgtatactactacaaagtacgaaactacgagacgacgaccgacgtaccgtacggttacgttatacgtggtagacgaagtacgtcgttacggtacggtccgggtaccggtacctaccgtaccgttgttaaccttacgtcgtactccgtcggtcgggtcctcgg

SEQ ID NO: 409426 - DNA, 608 bp, Homo sapiens
  misc_feature: GZ8MTXP02HGPCM.3.82.H05.1.454.CMB.2.raw
  modified_base (302)..(302): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtggaggaggcttgatccgagccgtgggggtcctgagactctctgtgcacgcctctggcttcaccgtcagtcgcagctagatgcacgtcgggtccnccgaggccgtaccggaggggaaggggcgtgggagtggggtctcgtagttatttacaagttctcggtaccacgtactaccgtacctcccgaccccggtagaacgggtcccgtaaattaacccagtacctacccgaagacgaaccgttacgttaccggaagtaaccgtacgggtatacgtacttaaacaaattacgaaactaccgtagaacgccgacgaccgtacgacggttcgtttatacgtgtggacgagagtacgtcggtagtcggtacggtctcgccgtagttctacttcgactcgtcggtcgg

SEQ ID NO: 409427 - DNA, 706 bp, Homo sapiens
  misc_feature: GZ8MTXP02GH59X.3.82.H05.1.454.CMB.2.raw
  modified_base (284)..(284): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagtcttgggttttccttgttgctatttacaaaaggtgtccagtgtgaggtgcaggtggtggagacgtggaggaggcttgactccgagccgtgggggtccctgagactctcctgtgcacgtcctctggcttccaccgtcagtancacgctacatcgcacgtcgggtccgccgacggcctaccggaggggaaggggtcgtgggaggtcgggttctcgtagttatttacaacgttcgtacgtacactacttaacctaccgtcccggacccgtaggaaacgggacccgtacttaaaccacttacctaccgaagaacgacgaacttaccgaaagaacgtacggtgttaactactaacaaatacgaaactaccgtagacgacgacccgacgaaccgtacggttaccgtttaagtccgtaggtcgaacgtaaggtaacgttacggttacggtaaacggggtttccgggggttaccggggtaaacccctcccgtttaaccccggttgggtttaacccttaccggtttacgtaccggttcccgttccggggtaccgggggtccccgttccgggg

SEQ ID NO: 409428 - DNA, 681 bp, Homo sapiens
  misc_feature: GZ8MTXP02HHXOI.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtgggaggaggcttgatccagccgtgggggtccctgagactctcctgtgcagcctcgtggcttcaccgtcagtagcagctacatcgccacgtcgggtccgccgaggcctaccgaggggaacggggctgggaggtgggtctcgtagttacttacaacttcgtacggtaccatactacctaccgtcccgacccgtaggaacggggtcctaacgttaaccactccgtccgaagaacgacgtacgttacccgaagtaaacgtcggtagttaacttacttaacaaaagttacgaaaactaaccgtaggaacgaaccggacccggaaaaccgtaccgtaaccgggttaccgtttaaacttacgttcggtaggaccggtaaaggtaacgtacggtttacgggtaacgggttcggggttacccggggaaccttccgtaacccgttggttaacctacgttcgtactcgtcggtcggggtccgtacgg

SEQ ID NO: 409429 - DNA, 683 bp, Homo sapiens
  misc_feature: GZ8MTXP02IFTTD.3.82.H05.1.454.CMB.2.raw
  modified_base (284)..(284): a, c, t, g, unknown or other
  modified_base (568)..(568): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttggggttttccttgttgctatttcaaaaggtgtccagtgtggaggtgcagggtgggtggagactgggaggaggcttgatccagccgtgggggtccctgacgactctcctgtgcagcctctggtctcaccgtcagtancagctacatgcacgtcgggtcccgccgacggcgtaccggaggggaacggggcgtgggaggtgggtctcgtagtttacttaactactttctacggtaacccaactacttacctacccgtcccgaacccccggttaggaaaccggggccgtaaacttaacccacgttccaccgaagacgtaacgtactaccggaagaaacgtcgggtatactacttaacaaaacgtacgaaaactaccgtggaagaccgaccccgaagtaccgacgggttaaccgttttataccgngggttacgacggaagtaggttacgttacggggaacggtttcggggtacccggggtaccctaccggtaacccccgtttggttaccttaccgttgtaccttcggttcggtccggggg

SEQ ID NO: 409430 - DNA, 612 bp, Homo sapiens
  misc_feature: GZ8MTXP02GFWP9.3.82.H05.1.454.CMB.2.raw
  modified_base (433)..(433): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctggcttcaccgtcagtagcagctacatgcacgtgggccgccgaggcctccgaggggaaggggctgggagtgggtctcgtagtttatttacaattctagtaccactatacctacctcccgacccgtgaaacgggcctacttaacatcctaccgagaacgacgacttccgaagtaacncgggttatactcttaacaaattacgaaacctaaccgtggaacgacggacccgaacgacccgtacggtcccttttaagtacctgtagacgagacgtgttggacggttcgggttccgggaccctcgtacccgtttggttaaccctacgttacgtacgtccgtcggtcgggggtaccctcgg

SEQ ID NO: 409431 - DNA, 635 bp, Homo sapiens
  misc_feature: GZ8MTXP02H4QY0.3.82.H05.1.454.CMB.2.raw
  modified_base (459)..(459): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggagcttgatccagccgtgggggtccctgagactctcctgtgcagcctctggcttcaccgtcagtagcagctacatgacacgtcggtccgcgaggcctaccggaggggaacggggcgtagggaggtcgggtctagtaagtttattactactttcgtcgtaacactactacctacctcccggacccgtagaacggggacctaacttaccactcctaccagacgtacgacttaccggaagtaaaccgtacgggtntaactacctaacgaaaatcgaaaacctactaggagaccgacgaccgaacgtaccggtcttttaagacgttgagacgaagtacgtagttcggacggttcggggtaccggtaccctaccgtacccggttcgtttcgaccgttacgtaccgttctaccgggttcggggtaccgtcccgg

SEQ ID NO: 409432 - DNA, 670 bp, Homo sapiens
  misc_feature: GZ8MTXP02FSUU8.3.82.H05.1.454.CMB.2.raw
  modified_base (537)..(537): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccaggccgtgggggtccctgagactctcctgtgcacgcctcgtggcttcaccgtcagtagcagctacatgcacgtcgggtccgccgaggcctaccggaggggaggggcgtgggaggtcgggtctacgtagtttaatttacagttccgtagtaccactactacctaccgtcccggacccgtaggaacgggcctaacttaaccatcctaccagacgacgacttaccgagtaacgacggttagtactcttacaaatacgaaaccaaccgtggaaggacgacccggaaccgaaccgtaccgggttacctttacgtttaacgngttacggacgtaagaggtacgtttacggtacgggttcggggttacccgggggacccttaccggtaccccgttggggttaacccttaacgttccggtaacgttcccggttcggtccgggggtcccgttaccggg

SEQ ID NO: 409433 - DNA, 593 bp, Homo sapiens
  misc_feature: GZ8MTXP02IPKI6.3.82.H05.1.454.CMB.2.raw
  modified_base (439)..(439): a, c, t, g, unknown or other
  modified_base (501)..(501): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactgggagggaggcttgatccagccgtggggggtccctgagactctcctgtgcagcctctggcttcaccgtcagtagcagctacatgccacgtggtccgccgaggcctccgaggggaaggggcgtgggaggtggtctcgtagttattactattctgtaccacactacctactcccgacccgtgaacgggtccgtacttaaccatcctaccagagacgacttcgaagaactacgggttntactcttacaaatagaaacacctaggacgacgaccgaacgaccgacggtacctttaatacgngtagcgagtacgtattggacggttcgggtaccgggacctccgtaccgtttggttaacctcgttacgacttccgtcggtcgggggaccgtcgg

SEQ ID NO: 409434 - DNA, 754 bp, Homo sapiens
  misc_feature: GZ8MTXP02I7S6P.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtgggaggaggcttgatccgagccgtgggggtccctgacgactctcctgtgcacgcctcgtggtcttccaccgtcagtagcagctacatcgactacgtcgggtccgcgaggcctccggaaggggaacggggcgtgggaggtggtctacgtagtttatttactaacttcgtacggtacactactaccttaccgtcccggaccccgtagggaaaccgggggtaccctaaacgttaaacccacgttacccgtaccgaaacggtacgaaccgtacgtttacccggaaaggtaaaacccgtacggggttaagttaacttaccgttaaacaaaacgttacgaaaaccgtaaaccttacgggaacggaaccgacccgggaaaccgtaccgaaccgggggtttacccttttaagtaaccgttggtacgtacggaaggtaggtacgttcggtaacggggttcggggttacccgggaccttacccgtacccgtttcgggttaacctttaaccggttcggtaaccttccggttaccggtccgggggttacccgtccggggg

SEQ ID NO: 409435 - DNA, 697 bp, Homo sapiens
  misc_feature: GZ8MTXP02ILNDV.3.82.H05.1.454.CMB.2.raw
  modified_base (319)..(319): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggtttccttgtgctattcaaaggtgtccagtgtgaggtgcaggtggtggagactggaggaggcttgatccagccgtgggggtccctgagactctcctgtgcagcctctggcttcaccgtcagtagcagctacatgcacgtggtccgccaggcctccgaggggaaggggctgggngtgggtctcgtagttatttacgaacttcgtaggtacctatataaccgtacctcccggtacccccgttaggaaacggggacccgtaacttaaacccgacttaccctacccgaaggtaacgaacgtaacgttacccggaaagtaaaccgaccggggttagtaacgtttaccttaaaccgaaaagttacggaaaacccaaaacccgttagggacgtaacggccccggtaaaacgacgtaaccgggttccgttttaattacgtggtacggacgaggtacgtacgttcggtaacggggttcgggttaccgggaccttacccgacccgtttgggttcctaaaccggtttcgtacttccgtacggttcgggggccgtttccgggg

SEQ ID NO: 409436 - DNA, 584 bp, Homo sapiens
  misc_feature: GZ8MTXP02HQ7CZ.3.82.H05.1.454.CMB.2.raw
  modified_base (299)..(299): a, c, t, g, unknown or other
  modified_base (424)..(424): a, c, t, g, unknown or other
  modified_base (441)..(441): a, c, t, g, unknown or other
  modified_base (497)..(497): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtggggtcccnccaggcctccgaggggaaggggctggtaggtggtctctagttatttacaattctgtaccacatactactcccgaccctgaacgggccgattaaccatctaccagacgacgattcccgaagtaacncggtgtatcttacaaanagtaacaacctggaacacggccaacgacacgggtcctttaattccgtagtgcgaanacggatttcgacggttgggttcccggggtaactcctaccgttggttaaccttacgtcggtatcgtaccgtcgggggtacccgtcggg

SEQ ID NO: 409437 - DNA, 611 bp, Homo sapiens
  misc_feature: GZ8MTXP02H4F2K.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctcgtggcttcaccgtcagtagcagctacatgcacgtgggtccgccaggcctccgaggggaagggctgggagtgggtctcgtagttattacattctggtaccacatacctacctccgacccgtgaaacgggccattaaccatctaccagacgacgtagttcccgaaagacacgggttataactcttaacaaaagttacgaaaacctaaaccgtaggacgtacgacccggaaccgaaccgtacggtccgtttaataaccgtgtacgacgacgtagtacgttcggaaggttcgggttaccggggaccttccgtaccgttggttcctacgttacgacttcgtcggtcggggtccgtacgg

SEQ ID NO: 409438 - DNA, 661 bp, Homo sapiens
  misc_feature: GZ8MTXP02IREI4.3.82.H05.1.454.CMB.2.raw
  modified_base (453)..(453): a, c, t, g, unknown or other
tcagagacgcactccacgaccggtgctcgatttagtcgagctctctcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccgccaggcctccgaggggaaggggctgggaggtgggtctcgtagttaatttacaacttcgtcgtaccactataccttactcccgtaacccgtagaaacggggtcctaacgttaaccaacttcctaccgaagaacgacgacttccgaaagaactcgggtntaactctacaaatacgaaactactggaacgacgccgaacacgtaccgggtcttttaatacctggtacgaccgaaggtagtacgtttacggaaggtttcgggggttacccggggaacccttcccgtaaccccggttttgggtttaaccctaaacccgttttcggtaaactttcccggttacccggtttcggggggggtaccccttcggg

SEQ ID NO: 409439 - DNA, 574 bp, Homo sapiens
  misc_feature: GZ8MTXP02FZSG0.3.82.H05.1.454.CMB.2.raw
  modified_base (485)..(485): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgcaggctccgaggggaggggctgggagtgggtctcgtagttattacaattcgtagtaccacatacctactcccgacccgtgaacggccgaattaccatctccagacgacgattacccgagaaacgcggttagtactcttacgaaatagaaaccaacgtgagacgccgacgacgacggtacgtttattacngtagcgagagtattcggaggttcgggttaccggggacctaccgcccgttaggttctaccgttcgacttccgtcggtcggggtccgtcgg

SEQ ID NO: 409440 - DNA, 710 bp, Homo sapiens
  misc_feature: GZ8MTXP02FIPWB.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactgggaggaggcttgatccagccgtggggggtccctgagactctcctgtgcagccgctggcttcaccgtcagtagcagctacatgcacgtcgggtcccgccgaggcctccggaaggggaacggggctggggaggtcggggtctacgtagtttaactttactaattctacggtacccacacttacctaccgtccccggaccccggtaggaacgggtcctaaacgttaaacccacttcctacccgaaggaacgtaaccgtaacgtttaccccggaacgtaaaacccgtaacggggtttagttaaacctttaccgtttaaacaaaacgtacggtaaaaccctaaacccgttagggaaacggaacggacccccggaaacggaaccgtaaccgggttacccgttttaataccgtgtacggacgtaaggagtacgttacgggaggttccggggttaccggggcccttaccgaacccgttggttacctacgttcgactccgtcggtccggggg

SEQ ID NO: 409441 - DNA, 654 bp, Homo sapiens
  misc_feature: GZ8MTXP02GZ3SA.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctcgtggccttcaccgtcagtagcagctacatgcacgtcgggtcccgccgaggcctccggaggggaacggggtcgtgggaggtgggtctcgtagttatttacaattcgtaggtaccactactacctacctcccgacccgtggaacgggtccctaattaaccactcctaccgagacgaacgtacttaccgaagtaaacgtacgggttatactaccgttacaaaagttacgaaaactaacccgtaggaacgacgacccgaaacgaccgtaaccggttacccgtttaatacgttaggtacgacgaggtaacgtacgttcggaacggttcggggtaccggtaccctccgtaacccgttggtaaccttaacgttcgtacttccgtacggtcggggtccggtccgg

SEQ ID NO: 409442 - DNA, 597 bp, Homo sapiens
  misc_feature: GZ8MTXP02F0VH8.3.82.H05.1.454.CMB.2.raw
  modified_base (276)..(276): a, c, t, g, unknown or other
  modified_base (442)..(442): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcgtggtttcctgtgctattcaaaggtgtccagtgtgaggtgcaggtggtggagacgtggaggaggcttgatccagccgtgggggtcctgagactctcctgtgcagcctctggcttcacgtcagtagcagctanatcgcacgtcgggtccgccgaggcctccggaaggggaacgggcgtgggagtgggtacctgtagttattacgaattcgtgtaacactactacctacgtcccgacccgaggtaacgggcccaacttaaaccgactctaccgagacgacgattacgaagaacgacggtntactctacaaatacgaaacactcgagacgaccgacgacgtacgtacgtttatactggtagcgaagtaggtacttaggacggtacggtaccggggtacctaccggtcccttagggttcctaaccgttcgtacgtccgtcggtcgggggtctccggg

SEQ ID NO: 409443 - DNA, 731 bp, Homo sapiens
  misc_feature: GZ8MTXP02FYCCA.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtgggaggaggcttgatccgagccgtgggggtccctgagactctcctgtgcacgctctggcttccacgtcagtagcagctacatgcacgtcggtccgccgaggcctaccggaggggaggggcgtgggaggttcggggtctacgtagtttaactttactaacgtttccgtacggtaacctactaactaccgtacccgttccccgggaccccgtaggaaaccggggtacccgtaacttaacccataccctacgaaggtaccgaacgtaccgttaccggaaagtaaccgacggggttcttaaactcccgttaaaacaaagttaaccgaaaaccaaaccgttggaaacgtaccggacccggtaaaccgtacccgttaaccgggttacctttttaagtaccgttggtacggacggtaaacgttagttacggttcgggtaaacgggtttcggggttacccggggaccctttacccgaacggttttcgttaaccgttacttccggtattccggtcggtcgggggcctttaccgg

SEQ ID NO: 409444 - DNA, 626 bp, Homo sapiens
  misc_feature: GZ8MTXP02H7RPR.3.82.H05.1.454.CMB.2.raw
  modified_base (259)..(259): a, c, t, g, unknown or other
  modified_base (470)..(470): a, c, t, g, unknown or other
  modified_base (502)..(502): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactgggaggaggcttgatccagccgtgggggtccctgagactctcctgtgcagcctcnggcttcaccgtcagtagcagctacatgcagtcggtccgccaggcctccgaaggggaaggggctagggaggtggggtactgtaagttaagtttacaacttccgtacggtaaccaactataaccgttactccccggtacccgtaggaaacgggggaccctaaattaaacccattcccaccagacgtacgagttacccgaagaactacggggtntaactacgttacaaattagaaacctaaacggngaacgacgaccgacgacgtcgttacttatacgtgagacgagtacgtagttggacggttcgggtaccgactacgtccgttaggtaacttacgtacgtacgttccgtacgggtcgggtaccgtcgg

SEQ ID NO: 409445 - DNA, 729 bp, Homo sapiens
  misc_feature: GZ8MTXP02G2CE8.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatcgcacgtcgggtccgccgaggcctaccggaggggaacggggctgggagtggggtctcgtaagtttactttacaatttccgtacggtaaccactacttaacccgttaccgtcccccggaacccccgttaggaaaccggggtacccgtaactttaaacccacttccctacccgaaggtaacggaaccgtaacttaccccggaaagtaaaccgacggggtttattaactttaccgttaaacaaaacgttacggaaaacccaaacccgttaggaaacggaccggaccccgggtaaacgaacccgtacggggttaccctttttaaagttaccgtggtagacggtaagtagtacgtttccgggaaggtttccggggttaccggggaacccttccggacccgtttagggttccctaacgttcgacgttccgtcggtcgggggtcctaccggg

SEQ ID NO: 409446 - DNA, 704 bp, Homo sapiens
  misc_feature: GZ8MTXP02GCB0B.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctggcttcaccgtcagtagcagctacatgcacgtgggtccgccaggcctccgaggggaacggggctgggaggtgggtctacgtagttatttacaactttcgtacggtaccactaacttaccttaacctcccggtacccccggttaggaaacgggggtacccgtaaacgtttaaacccattacccgacccgaaagggtacgaaccggtaatttacccccgggaaagtaaaccgtaccggggttattaacttccgtttaaaccaaaagttacgaaacccaaaccgttggaacgacggcccgaaacgtaccaccgggttaccgttttaataccgttggacgcgggtaaataggtacctttgggaacgggttcggggttaccgggacccttacctacccggtttaggttcctaacgtttcggactcggtttcggcgggggtaacccttcgg

SEQ ID NO: 409447 - DNA, 670 bp, Homo sapiens
  misc_feature: GZ8MTXP02HUNBX.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtcctgagctctcctgtgcagcctgcggcttcacgtcagtagcagctacatcgcacgtcgggtccgccgaggcctccggaggggaacggggcgtagggaggtgggtctagtaagtttatttaactaacttcgtacgtacactataacctaccgtcccggtacccgtaggaaaccgggtacccgtaacttaaccacttcccacgtaagacggtacgacttaccggaagtaaacgcgggttattactaccttaacgaaaattacgaaaccccaagttacgaacgacccgtaccggaacgtaaccgtacgggttacctttttaagaccgttggtacggtacgaaggtaacgtacggtttacgggacgtttcgggggttaccgggacccttccgtaccgtttgtaaccgttactacgtctcggtaccggtcggggtacctcgg

SEQ ID NO: 409448 - DNA, 723 bp, Homo sapiens
  misc_feature: GZ8MTXP02FRL40.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtcctgagactctcctgtgcagcctcgtggtcttcgaccgtcagtagcagctacatgcacgtcgggtccgcgacggccgtaccggaagggggaacggggtccgtaggggacggttcggggttactacgtaaggtttaactttaacaacgttttccgtacggtaacctactagttaccctaacccgtccccggtaacccccgtagggaaaccgggtaccccgtaactttaaaacccacttaccctacccgaaaggtaaccgaaccgtaacgttacccggaaagaaacccgtacgggttacttaaacttccttaaacaaaagttaccggaaaaccctaaaccgtaggaacgaacggaccccggtaaacgaaccgtaccggtttaacccgtttattaccggtgtacgacggtaagagtacgttacgggaggttcgggtaccgggacctccgaccgtttggtaacctcgttacgtactcgtcggtcggggctacgg

SEQ ID NO: 409449 - DNA, 724 bp, Homo sapiens
  misc_feature: GZ8MTXP02IXE5F.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagcttgggttttccttgttgctatttacaaaaggtgtccagtgtgaggtgcaggtggtggagacgtggaggaggcttgatccgagccgtgggggtcctgacgactctctgtgcagcctcgtggcttcgacgtcagtacgcacgctaacagtgaccgtacgtcggggtcccgccgacggccgtacccggaggggaacggggtcgttaggggaggttcgggttctacgttaagtttaactttactaaacgtttccgtacggtaaccaacttacttaaccgttacccgtccccggtaacccccggttagggaaaacccgggtaccgtaaaactttaaaccccacttccgtaacccgaaagaccggtaaacgtacgttaacccggaagtaaacccgtaggttacgtactacttaacgaaaatacgaaacctaccgagacgacgaccgaacgaactaccggtaccgtttatacggtcgtaggacgtaagacgtacgttcggtacggggttacgggttacccggggtaacctccgtaaccgttcggttaacttccgtacgtacgtccgtacggtccggggaccttccggg

SEQ ID NO: 409450 - DNA, 835 bp, Homo sapiens
  misc_feature: GZ8MTXP02JQXZG.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagcctacatcgcacgtcgggtccgccgaggcctacccggaggggaacggggcgtgggtaggttggggtactcgtagtttaatttactaactttcgtacgtaccaactacttaacctaccgtccccggtaacccccgggttaggaaaccgggggtacccgtaaacgtttaaacccgacttacccgtacccgacggtaaacggaaccggtaactttacccggaaacggtaaaacccgtaaccggggttacgttaaactttaccgtttaaacctaaaacgtttaaacggaaaacccgtaaaacccggttaggaacggaaaccgggaccccgggtaaacccggaacccgttaaacccggggtacccgttttttaaagttaaccggttacggttacggaccgggtaaaggtaacgggtttacgtttacggggtaacgggttacgggggtttacccggggggtacccttacccggttaaccccgggtttacggttttaacccgttaccgtttaccggttaccgtttccggtttaccggggttccgggggtacccgtttcccggggg

SEQ ID NO: 409451 - DNA, 566 bp, Homo sapiens
  misc_feature: GZ8MTXP02ILGS5.3.82.H05.1.454.CMB.2.raw
  modified_base (419)..(419): a, c, t, g, unknown or other
  modified_base (432)..(432): a, c, t, g, unknown or other
  modified_base (448)..(448): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcactgggtccgccaggctccgaggggaaggggctgggagtgggtctactagttattacacttctggtaccacgtatactactccgacccgtggaacgggccattaaccatactccgagagacgatacgagaacncggtgtactctanaatgaaacaacctgancgcgacgacgacggtcgtttatacgtgtcgagacgagtagttcggaggttacgggtcggggtacctcgtacccttacggttcttaacgttcgtacttcgtcggttcgggggcctcggg

SEQ ID NO: 409452 - DNA, 742 bp, Homo sapiens
  misc_feature: GZ8MTXP02HCJO1.3.82.H05.1.454.CMB.2.raw
  modified_base (258)..(258): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgcttatttacaaaaggtgtccagtgtgaggtgcaggtggtggagacgtgggaggaggcttgatccagccgtggggggtccctgagactctcctgtgcngcctctggcttcaccgtcagtacgcagctacatcgcacgtcgggtccgccgaggcctaccggaggggaaggggcgtagggaggtgggtctacgtagtttaatttacaactttcgtacggtaccactactaaccctaccgtccccggtaaccccgtagggaaaccgggtacctaacttaaacccattacctaccgaaaggacgaaaccgtacgttacccggaaagtaaaaccgtcgggtattaacttaccgtttaacaaaaacgttacgaaaaccctaaaccgttagggtaaacggaaccgggtaaccccgggaaaccgtaaacccggtacccgggttacccgttttaaagttaacccgtgggtacgaacggtaagtaacgtaggtttacggacggtttcgggggtaacccgggtacccttaccgtacccggttaggtttaaccttacgttaccgtacgttccgtcgggtccggggtcccgcggg

SEQ ID NO: 409453 - DNA, 643 bp, Homo sapiens
  misc_feature: GZ8MTXP02HZ9MG.3.82.H05.1.454.CMB.2.raw
  modified_base (254)..(254): a, c, t, g, unknown or other
  modified_base (436)..(436): a, c, t, g, unknown or other
  modified_base (491)..(491): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtgggaggaggcttgatccaggccgtgggggtcctgagactctcctgtgcngcctcgtggccttcaccgtcagtagcagctacatgcacgtcgggtccgccgaggcctccggaaggggaaggggtcgtggggaggttcgggtctcgtaagtttactttaactaacgtttcgtacgtaccaactacttacctacctcccggtacccgtaggaaccggtaccgtaacgttaaccnttaccaccgaagacgacgtacttaccgaagtaaacctcgggtatactacgttaanaaagttacaaacacgtagagacgccgaacgactacgggttactttagtcgtggtgacgaagtagtacgttggtacggttcgggttaccgggaccttacccgtaccgttcggttaacttacgtacgtcgtccgtcgggtcggggtccgtccgg

SEQ ID NO: 409454 - DNA, 584 bp, Homo sapiens
  misc_feature: GZ8MTXP02HCKMB.3.82.H05.1.454.CMB.2.raw
  modified_base (242)..(242): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttgtcgggcgactcggtcggttttaacngtagttggttagtctggtatcgagcaagaaaccgagggaaacgcccctagacgttcgtgatgtctgctgcactcccacccgtgaccgaaaggttcggaccgtcccacgtcccagtacttacgagtccgtacaggttagtaaagtccggtagggaaccgtaaggtacgtttccaacttctaccacctatacacgacacgcctcgacgacgcttagagttatttcgaacttaacttacttattacgactaacgacggtctacgaactcgtccctccgcttcgtaccgttcgggacggtacggaccgtaggtagaacgtagtaacgaacgagtacgcggactacg

SEQ ID NO: 409455 - DNA, 862 bp, Homo sapiens
  misc_feature: GZ8MTXP02HJTVK.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagcgttgggttttccttgttgcttatttacaaaaggtgtccagtgtgaggtgcaggtggtggagacgtggaggaggcttgatccgagccggtcgggggtccctgagctctcctgtgcagcctcgtgcttccaccgtcagtacgcagctacatgctacgtcggcccgccgaggccgtaccggaaggggaacgggcgtgggtaggttcgggtctacgttagtttaactttacgaactttcgtacgtaacctaacgtaacttaccgtaacccgtaccccgggtacccccggttaagggaaacccggggtacccgttaaaaccgtttaaacccgaacttaccctaaaccgaacgtaaaccggtaaaccgtacgtttaaacccggaaaacggtaaaccgtaacgggggttattaaccgttacctttaaaacgaaaaacttaccgaaaaaccctaaacccggtaaggaaacggtacccggaacccggtaaaaccggaaccggttaacccggggttaaccctttttaagttaaccgggttcggtacggtaaaccggaaacggttaacgggttaacgtttaccggggtaacggggtttaccgggggtttaacccggggtaacccccttaccggttacccccggtttaaggggtttaacccctttaacccggtttaccggtaacgtttacccgggtaccggggtttcccgggggttaccccggttaccggg

SEQ ID NO: 409456 - DNA, 515 bp, Homo sapiens
  misc_feature: GZ8MTXP02GQW16.3.82.H05.1.454.CMB.2.raw
  modified_base (293)..(293): a, c, t, g, unknown or other
  modified_base (388)..(388): a, c, t, g, unknown or other
  modified_base (407)..(407): a, c, t, g, unknown or other
  modified_base (415)..(415): a, c, t, g, unknown or other
  modified_base (422)..(422): a, c, t, g, unknown or other
  modified_base (426)..(426): a, c, t, g, unknown or other
  modified_base (432)..(432): a, c, t, g, unknown or other
  modified_base (451)..(451): a, c, t, g, unknown or other
  modified_base (465)..(465): a, c, t, g, unknown or other
tcagagacgcactccacgaccggtgctcgatttagtcgagctctctcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccnccaggctccgagggaaggggctgggagtgggtctcatcctattagtagtagtagtagttacatatctagcagactcagtgaagggcatcacatcncagagacacgccaagactnactgatcngacaaangaangctganacgccgaggaccacgggtntgtatacgttacgngtgtacgtaaggtttggtacggggacggtagtacggacggtacggccggg

SEQ ID NO: 409457 - DNA, 650 bp, Homo sapiens
  misc_feature: GZ8MTXP02G1R4F.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttccaccgtcagtagcagctacatgcacgtggtccgccaggcctccgaggggaacggggctgggaggtgggtctcgtagttattacaattcgtagtaccatactacctacgtcccgaccccgtaggaacgggtccaattaaacccatcccgtacccgaagacgacgtacgttaccggaagaaaccgtacggggttattaactactttaacaaaattacggaaacctaaacccgttggaacgacggtacccggaacgaacgtaccggtacgttttaatacgtggtaggacgaggtaagtacgttcggaacgggttggggttaccggggacctccgtaccccgttgggttcctacgttacgtacttccgtcggtcgggggccgttaccggg

SEQ ID NO: 409458 - DNA, 582 bp, Homo sapiens
  misc_feature: GZ8MTXP02I0GIH.3.82.H05.1.454.CMB.2.raw
  modified_base (260)..(260): a, c, t, g, unknown or other
  modified_base (447)..(447): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtgggaggaggcttgatccagccgtggggggtcctgacgactctcctgtgcagcctntggcttcaccgtcagtagcagctacatgcacgtcgggccgccgaggcctaccgaggggaaggggcgtgggaggttcgggtactcgtagttatttacgatttctcggtaccactatacctacccgtccgaccccgtaggaacggccgtaattaaccatcaccgagacgacactccgaagacgacggtntactctacaaatgaaacaaccgtgagacgaccgacgaccgacggtactttatacgtgtagcgagagtgtacgacggtcggtaccggcctacgtccttggttaactcgttacgtacgtcgtcggtcgggtcgtcgg

SEQ ID NO: 409459 - DNA, 699 bp, Homo sapiens
  misc_feature: GZ8MTXP02HUMQ3.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttacaaaaggtgtccagtgtgaggtgcaggtggtggagacgtgggaggaggcttgatccagccgtgggggtccctgagactctcctgtgcagcctctggcttcaccgtcagtagcagctacatgcacgtcgggtccgccgaggccgtaccggaaggggaacggggtcgtaggggaggttcggggtctacgtaagtttaactttaacaactttcgtacgtaccaactaacttaacctacccgtccccggaaccccgtaggaaaccgggtacccgtaaactttaacccacttacctaccgaagaacgtaaccgtacttacccggaaagtaaccgacggttatactacttacaaaatcgaaacctaccgtagaacgacgacccgaacgaccgtaaccggttaccgttttaagtaccgtggttaggaccgtaaaggtacggtagtttccgggaaaggtttccgggggttaaccgggacccttccgtacccgtttggtttaacctcgttacgtcttccggtccggtcgggggtccctacgg

SEQ ID NO: 409460 - DNA, 774 bp, Homo sapiens
  misc_feature: GZ8MTXP02GJ6PE.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctcgtggcttcaccgtcagtagcagctacatgccacgtcgggtcccgccgacggcctacccggaagggggaacgggggtcgtaggggacggttggggttcctacgtaagtttaacttttacgtaacgtttccgttacgggtaacccaacgtaacttaaccgttaacccgtcccccggggtaacccccgttagggaaaccggggtaccccgtaaactttaaaacccacttaccctacccgaaaggtaacgtaaccgtaacgttacccggaaagaaaacccgtacgggggttattaacttacctttaaaccgaaaagttaccggaaaacctaaacctagggaaagaccgaacccccggaaacgaacccgtaaccgggttaccggttttaaactaacgtcggtacgaccgggtaaagacggttacgttacgggtacgggttcggggttaccggggacccttacccgtacccgtttggttaacctaacgtttcggacttccggtcggtccgggggacctccggg

SEQ ID NO: 409461 - DNA, 840 bp, Homo sapiens
  misc_feature: GZ8MTXP02F660C.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccaggccgtgggggtccctgagactctcctgtgcacgcctctggcttcaccgtcagtagcagctacatgcacgtcggtccgccgaggcctaccggaaggggaacggggctgggacggtggggttcctacgtagtttaacttttaacgaaactttccgtacggtaaccctaacgtaacttaacccttacccgtacccccggtaacccccgggttacggggtaaaaccggggtaccccgtaaactttaaaaccccgtacgttaccctacccgaaacggtaaacggtaacccgtaacgttaccccggaaagtaaacccgtaccggggttagttaaacttccgttaaacctaaaacgtaacgtaaaaccctaaaacgttacggaaacggaccggaaaccccgggaaaccggaacccgtaaccggggttaccccgttttaaacggttaaccgttgggttaacggaccgggtaaggtaaacgggtaacccgtttaggggtaaacgggtttccgggggtttaacccgggggtaaccccttcccggtaacccccggttttagggtttaacccctttaccggtttacgtaccgttccggtttccggtaccggggggtcccttacccgggg

SEQ ID NO: 409462 - DNA, 708 bp, Homo sapiens
  misc_feature: GZ8MTXP02GFEGG.3.82.H05.1.454.CMB.2.raw
  modified_base (280)..(280): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttggtcgggcgactcggtacggttttaacagtatggttagtctggtatcagcaagaaaccgagggaaacncccctgacgttcctgatgtctgctgcactcccaccctgacaaggtcgacgtcccatccagtacttcagcgtacagtagagtcgagggaactagtacgttacacttcctaccacctatccgaagccaacgcctggaccacgtacccgttagtaaacgttagtttttaccggaacctttaaacttttacttaacgtttacggtaccgtaaaaccgtcggggtacctttacgggaaacccttacgggtttaccccctacccccggttcccgtttaaccggttacccggggtttttacccgggggaaccgggggtaaaacccgggggaaacccggtaaagggggttaacggaacggttaaaacgtaaacccggtaaaaaccggttaacggtttaccggggtacgggtaccttccggaacccgtttaaacccg

SEQ ID NO: 409463 - DNA, 665 bp, Homo sapiens
  misc_feature: GZ8MTXP02I38FR.3.82.H05.1.454.CMB.2.raw
  modified_base (274)..(274): a, c, t, g, unknown or other
  modified_base (475)..(475): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactgggaggaggcttgatccagccgtgggggtccctgacgactctcctgtgcagcctctggcttcaccgtnagtagcagctacatgcacgtgggtccgccaggctccggaggggacggggctgggaggtggggtctacgtagtttactttacaatttcgtacggtaccaactactacctacctacccggaccccgttaggaaccgggtacccgtaacttaaacccatcctacccaagaacgaccgtattacccggagtaaacgtacgggttntaactacttacgaaaatcgaaaacctaccgtaggaaggacgaccccgaacggtaccgacgggttaaccgtttataacgttggtacgacggaaggtacgtacggttccggtaaagggtttcggggtaccggggtccttaccgtaacccgttagggtttccctacgttcgtacttcggtacggttccggggg

SEQ ID NO: 409464 - DNA, 720 bp, Homo sapiens
  misc_feature: GZ8MTXP02I5MOC.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagcttgggttttccttgttgctatttacaaaaggtgtccagtgtgaggtgcgaggtggtggagacgtgggaggaggcttgactccgaggtccggtcgggggtccctgacgtacctctccctgtcgcacgtcctcgtcggtcttccaccgtcagtacgcacgctacagtcgcgacgtcgggtccgccgacggccgtaccggaaggggaacggggtcgtagggtagggttcgggttccgtagttaagttttaaactttaacgtaacctttcgtacggtaaccctaactaacttacccgttaccgtccccgggtacccggtacgggaaaccggggtaccgtaaccttaaaccgacttacccgacgaaaggtaacgaccgtacgttaaccggaagtaaacgtggttactacttactaaacaaagtacgaaacctaacgtggaacacggacccgtaaagacccgtacgttacctttagtactggacgtacgtagtaacgtacgttcgggacgggttcgggttaccggaccttacccggtacctttggttccttacgtcgtacgtccgttcggcggggtccctcgg

SEQ ID NO: 409465 - DNA, 534 bp, Homo sapiens
  misc_feature: GZ8MTXP02F51KU.3.82.H05.1.454.CMB.2.raw
  modified_base (280)..(280): a, c, t, g, unknown or other
  modified_base (336)..(336): a, c, t, g, unknown or other
  modified_base (444)..(444): a, c, t, g, unknown or other
  modified_base (499)..(499): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgtacttggtcgggcgactcgtcggttttaacagtagttggttagtcttggtatcagcaagaaaccagggaaacncccctagagttcctgatgtctgctgcatccacctgacaaaggtgactccatcagtntcgagtcgtacagtagatcgtgggactagagttcactctacaccatcagcagccagcagcctagaagttatttagactaactttatacttagacaacgtagactgacncgtacctccgacttcgtacgtttcgggcgtaacgggaccgaagggtacgagtaanaacgaaaacgtaacgtggtcggactacgactaacg

SEQ ID NO: 409466 - DNA, 580 bp, Homo sapiens
  misc_feature: GZ8MTXP02GGWS4.3.82.H05.1.454.CMB.2.raw
  modified_base (279)..(279): a, c, t, g, unknown or other
  modified_base (358)..(358): a, c, t, g, unknown or other
  modified_base (397)..(397): a, c, t, g, unknown or other
  modified_base (409)..(409): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctggtaggggacagagtcgctatgacttgtcgggcgacttcgacggttttaacagattggttagtctggtatcagcaagaaaccgaggggaaacncccccgtagacgttcctagatgtctgctgcactccacctgacaaagtcggactcccatccagacttcagtcgtacagtnactcgtaggggactaggtacttacacctctacacctaanacacgacacgcncgacacgacgtagtaacgttctttacgaacttaacttactacttacgtaacaacgtgtactacgtactcgtccctccgtcttaccgttacggttcgggacggtaacgggtaacgtaagggacgtaagaacgtaacgaaaacgtacggtacggtacgtacgtacgacctacg

SEQ ID NO: 409467 - DNA, 653 bp, Homo sapiens
  misc_feature: GZ8MTXP02HF37H.3.82.H05.1.454.CMB.2.raw
  modified_base (431)..(431): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccgccaggctaccgaggggaaggggctgggaggtgggtctcgtagtttatttacaattctgtaccacatactactcccgacccgtgaacgggccgattaaccatctaccgagacgacgacttccgaagtacacggtntaactcttacgaaatagaaacctaaccgtaggaacgtacgacccgggaacgaacccgtaccggttacccgtttaagtttaccgtggttacggaccgaaggtaacggtaacgtttcgggaaagggtttccggggtttaccgggggaacccttccgtaacccccgtttgggttaacccttacgttccggtacttccgttccgggtcgggggtaccccgttcggg

SEQ ID NO: 409468 - DNA, 539 bp, Homo sapiens
  misc_feature: GZ8MTXP02FXGMB.3.82.H05.1.454.CMB.2.raw
  modified_base (299)..(299): a, c, t, g, unknown or other
  modified_base (365)..(365): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactgggtcccncaggctccgagggaagggctgggagtgggtctcgagtttatttacaattctggtaccacatctacnccgacccgtgaagggccattaaccatctcagagacgatccgagaacacggtgtactcttacaaatgaaacactgagagaccgacgacgacggtcgtttatactgtgacgagagtattcggagttcggttcggggacctcgaacccgttggtactacgtcgactcgtcgtcgggg

SEQ ID NO: 409469 - DNA, 628 bp, Homo sapiens
  misc_feature: GZ8MTXP02GGZJ1.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagactggaggaggcttgatccagccgtgggggtccctgagactctcctgtgcagcctctggctcaccgtcagtagcagctacatgcacgtcgggtcccgccgaggcctccgaggggaagggcgtgggaggtgggtctacgtagtttaactttaacacgttcgtcggtaccactactacctacctcccggacccgtagaacgggccgtaattaacccatcctacccgagaacgacgtacgttaccgaacgaaccgtacggttagtacttacttaacaaaacgttacgaaacctaaaccgtagaacggaccgacccgacgacgtaccggtactttatacgtgtacgacgaagagtacgttcggaggttcggtaccggggacctccgaaccgttcggttacttacgttacgacttccgtcggtccgggg

SEQ ID NO: 409470 - DNA, 756 bp, Homo sapiens
  misc_feature: GZ8MTXP02HXUHU.3.82.H05.1.454.CMB.2.raw
  modified_base (250)..(250): a, c, t, g, unknown or other
  modified_base (488)..(488): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagctctcctgtncacgcctctggcttcaccgtcagtacgcagctacatcgctacgtcgggtccgcgacggctaccggaggggaacggggcgtgggaggtggtctcgtaagttatttacgtaactttcgtacggtaccacgtacttaccgtacctccccggtaccccgtaggaaaccggtccgtaacttaaacccgacttacccaccgaaggacgaaccgtacgttacccggaagtaaaccgtacgggttnttaaactcttaacaaaagtcgaaaacctaaccgtgggaaacgacggacccggaaaccgcgtaaccgggtcccgtttttaataccgtggtaacgtacggaaagtacggttaactttcgggggtaaacgggtttcccgggggtttaaacccggggaccccctttaaccggtacccccccggttttgggggtttttaaaccccttaaccccggtttcggtaacccgtttcccggtttccgggttaccgggggggtccccgtttaacccggg

SEQ ID NO: 409471 - DNA, 877 bp, Homo sapiens
  misc_feature: GZ8MTXP02GBJHU.3.82.H05.1.454.CMB.2.raw
  modified_base (274)..(274): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtgggaggaggcttgatccagccgtgggggtccctgagactctcctgtgcagcctcgtggcttcaccgtnagtagcagctacatgcacgtgggtccgccaggcctccgaggggaaggggctgggagtgggtctcgtagttatttacactttcgtgtaccactattacctacctccccggtaccccgtaggaaacgggacccgtaactttaaacccgacttaccgtacccgaagggtaaaccgtaacccggtaactttacccccgggaaagtaaaaccccgtaaccggggggtttacgtaaactttacccgttttaaacaaaaaacgtttaccggggaaaaacccctaaaaccccggtttaggggaaaccggttaaccggggtaaaccccccggggaaaacggaacccccgttaaacccggggggtttaccccctttttttaaaagttaacccccggtttgggttaccgggacccgggtaaaggggttaaaacggttaacggtttacccgggggtaaaggggtttccgggggtttacccggggggaaccccctttacccggtaaccccccggtttttgggggttaacccccttttaaacccggtttcccggggtaaaacttttccccggtttacccgggggtttacggggggggtcccccccgttttacggggg

SEQ ID NO: 409472 - DNA, 567 bp, Homo sapiens
  misc_feature: GZ8MTXP02FMTBI.3.82.H05.1.454.CMB.2.raw
  modified_base (479)..(479): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccgccaggctccgaggggaggggctgggagtggggtctcagttatttacaattctggtaccacatacctactcccgaccccgtgaacgggccgattaaccatctccagacgacgattccgaagaaccacggtgtatcttacaaatagaaacaacctgagagcccgacgaccacggtccgtttatacngtgcgagagtatcggagtcgggttacggggaccctcgaccccgttggttaacctacgtttacgacttcgtcgtcgggggccgtccggg

SEQ ID NO: 409473 - DNA, 707 bp, Homo sapiens
  misc_feature: GZ8MTXP02J1XXK.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctctgtgcagcctctggcttcacgtcagtagcagctacatgcacgtcgggtcccgccgacggcctaccggaggggaacggggtcgtgggaggttcggggtctacgtaagtttatttaacgtaacctttcgtaggtaaccctactacttaaccttaccgtcccggaacccccgtagggaaaccggggtacccgtaacttaaacccaacttccctacccgaagaacggacgtaacgttacccgaaagaaccgtacggtacgttacttaccttacaaagtacgaaacctaaaccgtacggaagacgacccggaacgaacctaccgggttaccgtttaagttaccgtggtacgacggagaacgtacgttcggtacgggttacggggttaccggggaacccttacccgtaccccgtttacggtttccgttaaccgttccgacgttccgtccggttcgggggcccgtccgg

SEQ ID NO: 409474 - DNA, 599 bp, Homo sapiens
  misc_feature: GZ8MTXP02F58QI.3.82.H05.1.454.CMB.2.raw
  modified_base (291)..(291): a, c, t, g, unknown or other
  modified_base (360)..(360): a, c, t, g, unknown or other
  modified_base (364)..(364): a, c, t, g, unknown or other
  modified_base (476)..(476): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatcgtggtaggggacagagtcgcttagtgtacttggtcgggcgactcggtacggttttaaacaggtatgggttagtctggtatcagcaagaaaccgagggaaacncccctagtacgttcctgattgtctgctgcactcccacctgacaagtgactccatccagtatcagccgtnagtnaactcggtaggacaggtatccacttcaccacatacacgcacggcctggaccacgtcctaaggtaacttagtttacgaattaacctttacgtattacgacaaagtcggtaccntaacggtctaccctcccgacttacccgttacggttacgggggaccgggttaaacggaccggtaaagggtaggaacgttaaacgaaaacccgtaaggtaaccggtggtttcgggactaaccggg

SEQ ID NO: 409475 - DNA, 622 bp, Homo sapiens
  misc_feature: GZ8MTXP02IFN2A.3.82.H05.1.454.CMB.2.raw
  modified_base (298)..(298): a, c, t, g, unknown or other
  modified_base (466)..(466): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactaaccatggagttttggctgagctgggttttccttgttgctattcaaaaggtgtccagtgtgaggtgcaggtggtggagacgtggaggaggcttgatccagccgtgggggtccctgagactctcctgtgcagcctctggcttcaccgtcagtagcagctacatgcacgtcgggtccnccaggcctccggaaggggaggggctgggagtgggtctcgtagtttatttacattccgtacggtaccactactactacccgtcccgaccccggtgaacggggcctaattaaccatcctaccagacgacgtacgttaccgaagaaaccacggttgtaacttaccttaaanaaacgtacgaaaacctacgagaacgaccgaccgacgaccgtacggttactttatacgtgcgagagtagtacgttcggaggttcgggtaccggacctccgtacccgtttgttaccttaacgttcgtacttcggtcggtccggggtccgtacggcccg

SEQ ID NO: 409476 - DNA, 560 bp, Homo sapiens
  misc_feature: GZ8MTXP02JTPUM.3.82.H05.1.454.CMB.2.raw
tcagagacgcactccacgaccggtgctcgatttagtcgagctctctcgcgggggagtcagacccagtcaggacacagcatggacatgagggtccccgctcagctcctggggctcctgctgctctggttccccaggttccagatgcgacatccagatgacccagtctccatcctccgtgtctgcatctgtaggggacagagtcgctatgacttggtcgggcgactcgtcggttttaacagtatggttagtctggtatcagcaagaaaccagggaaacgcccctgacgttcctgatgtctgctgcactcccaccctgacaaagtggacgtacccatccagtacttcagcgtcagtgactcgtggacagtacttcactctccacatcacgcagcctgcacgcctagtaacgtatttacgactaactttactattacgtacaacgtacggactacggtacacgtcccgtccccgtcctaccgtaccggtttaccgggaccgggtaaacgggaccggaaggtcggaagtacgtaacgaaacgacgtaggtgtcgtcaccgtaacc

SEQ ID NO: 409477 - DNA, 624 bp, Homo sapiens
  misc_feature: GZ8MTXP02I1HRX.3.82.H05.1.454.CMB.2.raw
  modified_base (374)..(374): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtcctgagactctcctgtgcacgcctctggcttcaccgtcagtagcagctacatgcacgtcgggtccgcaggcctccgaggggaaggggctgggaggtgggtctcgtagtttattactaattcgtgtacccactatacctacncccggacccgtaggaacggggcctataaccatcctaccagtagaacgtacgttaccgagaaaccgtacggtagtactacgttacaaaagttacgaaaccaaccgtagaaggacgacccggtaacgaaccgaccgggttacctttagtacctgtggacgaagacggtacgttacggacggttcgggtccggggtacctaccgtaccgttcggttcctacgttcgtacgtccgtcggtccgggggactccgg

SEQ ID NO: 409478 - DNA, 789 bp, Homo sapiens
  misc_feature: GZ8MTXP02J0YW8.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtggaggaggcttgatccaggccgtgggggtccctgagactctctgtgcacgcctcgtcggtcttcaccgtcagtagcagctacatcgcacggtcggcccgaccgaggcctaccggaagggggacggggcgtaggggacggttcgggtctacgttaagtttaacgtttactaacgtttccgtacggtaaccctaacgtacttacccttacccgtcccccgggtaaccccggtacgggtaaaccgggacccgtaacttaacccgactacccgtaccgaaaggacggtaaaccggtaccgttaccggaaacgaaccgtaacggggttacttaacgttaccttaaacgtaaaactaaccggtaaaacctaaaccggttaacggaccggaaccggaaccccgggaaaccgttaacccgtaacccggggtttaccgtttaacgtttaacgtgggttaaccggacgggaaagtacggtaacggtttccgggtaacggggtttccggggttaccccggggtacctacccggtacccgtttcggtaacctttccgtaccgtacgttccgtcgggtaccggggtccgtaccgg

SEQ ID NO: 409479 - DNA, 691 bp, Homo sapiens
  misc_feature: GZ8MTXP02G90TE.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtgggaggaggcttgatccgaggccgtggggggtccctggacgactctcctggtgcagcctgtcggcttccaccgtcagtagcagctacatgcctacgtcgggtccgccgaggcctaccggaggggtaacggggctggggtaggtgggtctacgtagtttattaacgaactttcgtacggtaccctactacttacctacccgtacccgaccccgtagggaaaccggtcccgtaaacttacccattccctaccgaaggaacgaaccgtacgttaccggaagtaaaccgtaccgggttattaacttaccgttacaaaagttacgaaaccaaaccgtgaaacgacgacccgaacgaccgtacgggtaccgtttaatccgtagtacgcgtagtaagtacgttacggtacggtcgggggttaccgggaccttaccgtacccgttaggttcccttacgttaaccggctccggtcggtccgggggtcctccggg

SEQ ID NO: 409480 - DNA, 798 bp, Homo sapiens
  misc_feature: GZ8MTXP02FRGGC.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccagccgtgggggtcctgagctctcctgtgcagcctctggtcttcaccgtcagtagcacgctacagtcgaccacggtcggggtcccgaccgacggcccgtaccggaagggggtaacggggcgtggggaggttcggggttacctcgtaagttttaactttaacaacgtttccgtacggtaaccctacgtaacttaaccctacccgttccccggaacccccggtagggaaaccggggtaccctaaacttaaacccgacttccctaaccgaaaggaaccggtaacgtaacgttaccggaaacgtaaaacgtacgggttattaactacctttaaacaaagttaacgaaaaccgtaaccgtaggaacggtaaccggacccgggtaaaccgtaaccggtaaccgggtttacccgtttaaagttaccgtgggttaacgacggtaaaggtaacggttagtttaccggggtaaaggtttccgggggttaacccgggggtacccttacccgttacccggttttagggttaacccttaacggttaccggtacgtttccggtaccggggtttcgggggcccctttcgggg

SEQ ID NO: 409481 - DNA, 728 bp, Homo sapiens
  misc_feature: GZ8MTXP02HYRIM.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagactgggaggaggcttgatccagccgtgggggtcctgagactctctgtgcagcctctggccttcaccgtcagtagcagctacatgcacgtcgggtccgccgaggccgtaccggaaggggaacggggcgtagggaggttcgggtctacgtaaggtttaactttaacaactttcgttacggtaacccacgtaacttaccttaccgtccccggaaccccggttaggaaaccgggtcccgtaaactttaaacccattcccgtaaccaaggaaacgtaccgtaactttacccgggaaagtaaaccgtacgggggtttacttaaacttcccgtttaaacaaaacgttacggaaaacctaaccgttagggaacgacggacccggaacggtaaccgtaacccgggtttaccgtttttaaacttaccgtggttacgacggtaaaggtcgtaacggtttcgaacggttcggggtaccgggtaccctccgtaaccgttggttcctaacgttcgacttcgtcggtcggggtccgtccgg

SEQ ID NO: 409482 - DNA, 627 bp, Homo sapiens
  misc_feature: GZ8MTXP02GA7K6.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccaggccgtgggggtccctgagactctcctgtgcacgcctcgtggtcttcaccgtcagtgcacgctacatcgcacgtcgggtccgccgaggccgtccgaggggaaggggctgggaggtgggtctcgtagtttattacaacttcgtacgtacactatacctactcccgacccgtaggaacggacctaacttaaccactcctaccaagacgaacgtacttacccggaagtaaaccgtacgggttataacttccgttaaacaaagttcgaaaaccaccgtgaagacgaccgaacgaccgacgggttcctttaatacgtgtaccgagtagaagttcgtcggacggttcgggtacccgggaccttccgacccgtttgttcctacgttcgacttccgtcggtcggggcttccgg

SEQ ID NO: 409483 - DNA, 972 bp, Homo sapiens
  misc_feature: GZ8MTXP02FU3OY.3.82.H05.1.454.CMB.2.raw
  modified_base (818)..(818): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggtagtttggctgagtcgttgggttttccttgttgcttatttacaaaaggtgtccagtgtgaggtgcgagggtggtggagacgtgggagggaggtcttgactccgacggtccgggtcgggggtccctggacgtaccttcctccgtgtcgcgacgtcccttcgtcggtacccttccgaccgtacgtaacggtacgaccgacgtacctaacgtacgtcggacccgtaccggggttcccggggtacccccgaccggtaccgggtcccggtacccggggaaagggggtaaccgggggtcggtacgggggttaacgggtttccggggtacctttaacggtttaacgtttttaaccgtttaaaccgttaacgtttaccgttaaccggttaaaccctaaaccgttaacccgttaccccgttaacccccgtacccccgggtaaacccgggttaaccggggaaacccggggtaaccccgtaaaacttaaccccgtacgttaccctaaccggtaaacggaaaccggtaacccggtaaccgttaacccggaaacggttaaaaccgttacgggtttaacttactaacccgtttaaaaacgaaacgtaaaccggtaaaacctaaccggttacgggaaaccgggtaacccggaaccccggaaaccggttaacccggttaaccgggttttaaccgtttaaacncggtttacgggaacgtaaacgggtaagtaaccggttacgggtttaaccggggttacggggttcccgggggttaaccccggtcccttaacccggttaaccgtttacgggttacccttacggttccgtaacgttcccgggttacggggtcccgggg

SEQ ID NO: 409484 - DNA, 552 bp, Homo sapiens
  misc_feature: GZ8MTXP02JG8I9.3.82.H05.1.454.CMB.2.raw
  modified_base (334)..(334): a, c, t, g, unknown or other
  modified_base (350)..(350): a, c, t, g, unknown or other
  modified_base (357)..(357): a, c, t, g, unknown or other
  modified_base (423)..(423): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgcttatttcaaaaggtgtccagtgtgaggtgcaggtggtggagactggaggaggcttgatccaggccgtggggggtccctgagactctcctgtgcagcctctggcttcaccgtcagtagcagctacatgcacgtggtccgccaggctccgaaggggagggctgggagtgggtctnagttatttacattcgngtaccanatactactccgacccgtgaaacggccgaataaccatcctaccgagagacgtattacccgagtaacnccggtagtactcttacaaatcaaacaactgacgagaccgacacgacggtactttagtactgtgcgagagtatcgaggtggtcgggactccgaccgttggtcctcgtacgactcgtcgtcggggactcgg

SEQ ID NO: 409485 - DNA, 697 bp, Homo sapiens
  misc_feature: GZ8MTXP02H68VB.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttccaccgtcagtagcagctacatgcacgtcgggtcccgccgaggcctaccggaggggaaggggtccgtgggaggtgggtcctagtagtttacttaacgtactttcgtacggtaacccactaactacccgtacctaccccggacccccgggttagaaacccgggggtaccgtaaactttaaaccccgatttacccgacccgaagaaccgtacgaaccgtttacggaaacgtaacgacgggttatacttacgttaaacaaagttaccgaaaactacgtacgaacgacgaccgacacggtaccgttacgtttatacgtgtacggtacggaggtaacgttacgttacgggtacggtttacgggggtacccgggtaccttacccggtaaccgttccggtttatacccgttacgacgtttcggtccgggtacccggggg

SEQ ID NO: 409486 - DNA, 658 bp, Homo sapiens
  misc_feature: GZ8MTXP02JHU7B.3.82.H05.1.454.CMB.2.raw
  modified_base (270)..(270): a, c, t, g, unknown or other
  modified_base (491)..(491): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtcctgagactctcctgtgcagcctcgtggtccttcnccgtcagtgcagctacatgcacggtcggtcccgcgacggtcctaccggaggggtacggggtcgtagggtacgggtcgggtcctacgttagtttaccttacgtacttcgtacggtacccacacttacctacctcccggtacccgtaggaaccggggcctaacttaaccgactcctaccgagacgacgtactaccgaacgacacgggtattactacgttaaanaacgtacgaactaacgtaggaggaaaccgcccggaaacgtaccggtaaccgttctttaacgtagtcgtggaaccggtagaggttacgtacggtagggtccggtaccggggtaaccctcgtaaccccgttaggtttacctactacggtcttccggtcgggttccgggg

SEQ ID NO: 409487 - DNA, 547 bp, Homo sapiens
  misc_feature: GZ8MTXP02FGS77.3.82.H05.1.454.CMB.2.raw
  modified_base (478)..(478): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtggtccgccaggctccgaggggaaggggctgggagtggggtctcagttactttacaattctggtaccacatacctactcccgaccccgtagaacgggccgattaaccatctccagagacgattcccgaagacacggtgtactctacaaatgaaccaactgagagccgacgaccacgggtcctttaatcngtgcgtagacgattcgagttcggttcggggacctcgaccctggttccacttcgatctcgcggggctcgg

SEQ ID NO: 409488 - DNA, 548 bp, Homo sapiens
  misc_feature: GZ8MTXP02FH4J8.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgaggggaggggctgggagtgggtctcagttatttacaattctgtaccacatacctactcccgaccccgtgaacgggccattaaccatctaccagagacgattccgagaacacggtgtatctacaaatgaaacaacctgagacgacccgacgaccgacggtacgtttatactgtgcgagagtattcgagtcggtcgggacctccgacccttggtctacgttcgactcgtcgtcggggccgtcgg

SEQ ID NO: 409489 - DNA, 575 bp, Homo sapiens
  misc_feature: GZ8MTXP02IYBOW.3.82.H05.1.454.CMB.2.raw
  modified_base (382)..(382): a, c, t, g, unknown or other
  modified_base (387)..(387): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttggtcgggcgactcggcggttttaacagtatggttagtctggtatcagcaagaaaccaggaaacgcccctagacgttcctagatgtctgctgcactcccacctgacaaagtgacgtcccagtacagacttcagcgttacagtgaatcgtaggacacgtagtcacttcncaccntacagcacgtctcgactcgacctagtaaacggttatttcgtactaaactttacttaacttacggtactaacgaggtactcgaacgtacgtccctacccggtcttaccgtacggtttaccgggacgggtacggtaaacgtagggtacgtaagaacgtaacgtaaaacgtacgtggtaacgttcgtaacg

SEQ ID NO: 409490 - DNA, 563 bp, Homo sapiens
  misc_feature: GZ8MTXP02FK8FY.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctattttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccaggggaaggggctgggagtggggtctctagttactttacgaattctggtaccacatactactccgaccccgtgaacggccgattaaccatctccagagacgattccgaagaacacggtgtatctacaaatagaacaacctgacgagcccgacgacacggtccgtttatactgtagcgagagtacttcgacggtcggttacgggggacccttacgaaccccgttggttacctacttcgattccgtcgttccggggg

SEQ ID NO: 409491 - DNA, 664 bp, Homo sapiens
  misc_feature: GZ8MTXP02JPKSY.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctcgtggcttcaccgtcagtacgcagctacatgccacgtcgggtccgccgacggccgtaccggaggggaacggggcgtgggaggtgggtctcgtagtttatttactaacttcgtacgtacctactactacctaccgtcccgacccggtaggaacgggtaccgtaattaaccactctaccgagacgacgtataccgaagaaccgtacggtagttacttactaacaaagtacgaacctaaccgtgacgacggacccgacgaccgtaccggttacctttatacgtggtcgacgtaaggtagtacgttacgggtacggttccggggttccggggtaacccttcccggtaaccccgtttgggttaaccttaccgtttcggacgtttccgtcgggtccgggggtacccttccggg

SEQ ID NO: 409492 - DNA, 610 bp, Homo sapiens
  misc_feature: GZ8MTXP02HGQO2.3.82.H05.1.454.CMB.2.raw
  modified_base (341)..(341): a, c, t, g, unknown or other
  modified_base (354)..(354): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtggaggaggcttgatccgagccgtgggggtccctgagactctctgtgcacgcctctggcttcaccgtcagtagcagctacatgcacgtcgggtccgccaaggcctccggaaggggaggggctggagtgggtcncgtagttacttanattctaggtaccactatacctacctccggaccccgtagacgggtaccattaaccgactctacccagacgaacgacttcgaagtaacgacggtatactacgttaacaaatacgaaactaccgtgaacgacgtccgaaccgacgtaccggttacgtttaatacgtagtcgacggagagtacgttacggaacggttgggtacccggggcctaccgtaacccgttaggtccttacgttcgtacttccgtcggtccggggg

SEQ ID NO: 409493 - DNA, 630 bp, Homo sapiens
  misc_feature: GZ8MTXP02JBWRK.3.82.H05.1.454.CMB.2.raw
  modified_base (256)..(256): a, c, t, g, unknown or other
  modified_base (269)..(269): a, c, t, g, unknown or other
  modified_base (297)..(297): a, c, t, g, unknown or other
  modified_base (448)..(448): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctntggcttcaccgtnagtagcagctacatgcacgtcgggtccnccgaggcctaccgaggggaacgggcgtgggaggttggggtctacgtagtttactttacaactttccgtacgtaccactactaacctacctcccggacccgtagaacgggacctaattaaccatcctacagagactacgttacgaagtaacncggtagtactctacaaatcggaaactacgtagacgacgaccgaacacgtaccggtacctttagtacgtcggtagacgtaagtacgtacgttaccggaggtttccggggttaccggggtaccctaccggttacccgttggttaaccttaccgttcgacttccggtcggtcggggtaccgtcgg

SEQ ID NO: 409494 - DNA, 802 bp, Homo sapiens
  misc_feature: GZ8MTXP02GV1PR.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctcgtgcttcaccgtcagtagcacgctacatgaccacgtcggtcccgacgacggccgtacccggaaggggaacggggcgtaggggtacggttcggggttcctagtaacgttttaactttaacgtaaacgtttccgtacggtaaccctaactacgttaaccgttaacccgtcccccgggaacccccggttagggaaaccggggtacccgtaaacttaaaaccccgactacccgtacccgaaagaacgtaaaccgaacgttacccgaaaagaaccgtaccgggttagtttaaaccttccttaaacaaaagttaccgaaaacctaaccgtaggaagacgaccccggaaacgtaaaccgttaaccgggttaccgttttaaacgttaccggttaggtacggtaaccggtaagggtaaagttacggtttaccgggaaacgggttttcgggggtttaaaccccgggggccctttaaccggttaacccccgtttggttaacccgttaacgtttcggtacttcccgttacgggggtccggggttcccgtaccgggg

SEQ ID NO: 409495 - DNA, 701 bp, Homo sapiens
  misc_feature: GZ8MTXP02GMYQ5.3.82.H05.1.454.CMB.2.raw
  modified_base (290)..(290): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgcaggtggtggagacgtggaggaggcttgatccgagccggtgggggtcctgacgactctctgtgcagcctcgtcggtctcgaccgtcagtagcagctacntgctacgtcggtccgcgaggcctccggaggggagggcgtgggaggtcggtctagtagttattacaacttcgtacgtacactactacctaccgtcccgacccgtaggaacggtccgtaacttaaccactacctacgaagtaacgaccgtaacgttacccggaagtaacgtacgggttactaactaccgttaaacgaaactacgtaaaacctaaaccgtaggaacggaccgacccggaaccgtaaccgtaaccgggtttacttttaaacgttacgttggtacggacggtaaggtaacgttacgggtttacggaacggggtttccgggggtacccggggtaccttaccccggtaccgtttacggttaaccgttacccgtacgtacgttccggtcgggtccgggggtcctccggg

SEQ ID NO: 409496 - DNA, 664 bp, Homo sapiens
  misc_feature: GZ8MTXP02GIHYP.3.82.H05.1.454.CMB.2.raw
  modified_base (578)..(578): a, c, t, g, unknown or other
tcagagacgcactccacgaccggtgctcgatttagtcgagctctctcgcggggggagaggagcccagcactgggattccgaggtgtttccattcggtgatcagcactgaacacagaggacctcaccatggagttttggctgagcgtggtttcctgtgctattacaaaggtgtccagtgtgaggtgcaggtggtggagactgggaggaggcttgatccgagccgtgggggtccctgagacctctcctgtgcacgcctcgtggccttcaccgtcagtagcagctacatcgcacgtcgggtccgccaggtcctaccggaaggggaacggggtcgtagggaggttcggggtacctcgtaaggtttaacttacgaaactttccgtacggtaaccactactaccttaccgtcccggtaacccgtaggaacgggacctattaaccatctaccagtaacgacgtacttacccgaagtaacgacgggttattaatcttaacgaaatacggaaacctaaccgtaggaacgaccgaacccggacgtaaccggaccgggttaccttttaataccggtgtaccgcggtaanacggtaagttccggaaaggttcgggtacccgggtaccctaccgtaccgttcggttaactcgtacgcttccgtcggtcggggctcgg

SEQ ID NO: 409497 - DNA, 714 bp, Homo sapiens
  misc_feature: GZ8MTXP02IN48E.3.82.H05.1.454.CMB.2.raw
  modified_base (297)..(297): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtcctgagactctcctgtgcagcctctggcttcaccgtcagtagcagctacatgcacgtgggtccnccgaggcctaccggaggggaacggggtcgtggggacggtgggtctcgtaaggttaactttactaactttcgtacggtaacccactacgttaacccttaccgtccccgacccgtacggaaaccgggacccgtaacttaaccaacttcctacccaggacgtaacgtacgttccggaaagtaaacgacgggttactaacttaccttacaaaaacgttcgaaaacctaaccgtacggaaacgacgacccggaaaccgaacgtacccggtacttttaagtaccgttgggtacgacgaacggtagtacggtttcgggtaacggttccgggggttaccggggacccttaccgtaacccggtttcggttaacccgttacgttccggtaacttcccggttccggttcgggggtaccccgttccggg

SEQ ID NO: 409498 - DNA, 560 bp, Homo sapiens
  misc_feature: GZ8MTXP02HJAIN.3.82.H05.1.454.CMB.2.raw
  modified_base (397)..(397): a, c, t, g, unknown or other
  modified_base (456)..(456): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccgaggggaaggggctgggagtgggtctcgagttatttacaattctggtaccacatactactcccgaccccgtgaacgggccgattaaccatcncccagagacgattccgaagaacacggtgtatcttcaaatgaacaaacctgagagccganaccgacggccgtttaatactgtgcgaagacgattcgagtcgggttacggggacctcgaccccgtggttcctaacgttcggacttcctcgtcgggggaccgtcgg

SEQ ID NO: 409499 - DNA, 713 bp, Homo sapiens
  misc_feature: GZ8MTXP02FICTC.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtcccgccgaggcctaccggaaggggaacggggcgtaggggtaggttcggggtctaccgtagtttaactttaacaacgtttcgtacggtaacccacgtaacttacctacccgtaccccggtacccccggtaggaaaccggggtacccgtaaactttaaacccacttcctacccgaagaacgaacgtacgttacccggaagaaaccgtacggttgtaaccttacgttaacaaatacgaaaccaacgtgaacgacgacccgaacgaaccgtaccgggttaccgtttaagtacgtcggtacggacggtaagtaaggttacgttaccgggtacgggtttacgggggttacccggggaccttacccgtaacccgtttacggtttaccttacgttccgtaacgtccggttcgggttcccggggg

SEQ ID NO: 409500 - DNA, 792 bp, Homo sapiens
  misc_feature: GZ8MTXP02FOLKB.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggtcttgactccaggtccgtgggggtccctgagactctcctgtgcacgcctcgtggtcttcgaccgtcagtgcagctacatcgcgacgtcgggtccgccgaggtccgtacccggaagggggaacggggtccgtaggggtacgggttcggggttaccttacgtaaggttttaacttttaacgtaaacgttttccgtacggtaaccctaacgtaacttaacccgttaacccgtcccccgggaaccccggttacggggaaaaccggggtaccccgttaaacctttaaaaccccacgttacccgtaaacccgaacggtaaacggtaaaccggtaacgtttacccggaaaggtaaaccgtacggggttattaacttacgttaaacgaaaacgttaaccgaaaccgtaaccgtaggaacggtacgaccggaacgaccgtaaccggttacgtttacgttacgtgtacgacggtaagtagtacggtttacggtacgggttcggggttacccggggtacccttaccgtaacccgtttcgggttaaccttaacgttcgacgtttccgtccggtcgggggtcccttccggg

SEQ ID NO: 409501 - DNA, 782 bp, Homo sapiens
  misc_feature: GZ8MTXP02JSZP4.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccagccgtgggggtccctgacgactctcctgtgcagcctcgtggcttcaccgtcagtagcagctacatgctacgtcgggtccgccgaggcctccggaagggggaacggggcgtaggggacggttggggtcctacgttaaggtttaactttaacgaaacgtttccgtacggttaaacccaactacttaaccgtacccgttcccccgggaacccccgggttagggaaacccggggtacccgtaaactttaaaccccaacttaccccgtacccgaaaggtaacggtaacccgtaacgtttaccccgggaaagtaaacccgtaccggggttagttaaacctttaccgttaaacctaaaagttaccgaaaacctaaacccgttagggaaacgaaccgggacccgtaacgaacccgtaccgggttacccgttttaagtaccgtggtaacggcggtaaagtaggtacgtttacgggaacgggttcggggttacccggggtaaccttcccggtaaccgttcggtttaacctacgttacgacgttccgttacgggtccgggggtccgtccgg

SEQ ID NO: 409502 - DNA, 704 bp, Homo sapiens
  misc_feature: GZ8MTXP02GDVS6.3.82.H05.1.454.CMB.2.raw
  modified_base (490)..(490): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtggaggaggcttgatccgagccggtcggggggtcctgacgtactctcctgtgcacgcctcgtggtcttcgaccgtcagtagcagctacatcgcacgtcggtccgcgacggcctacggaggggaacggggtcgtagggaggttcgggtctacgtagtttacttaactacgttcgtacgtaaccaactactacctaccgtcccgaaccccgtggaaacgggtcctaacttaaaccagtcctacgaagtacgacgtacgtacgaagaacgtcggtatacgttctaanaaacttacgaaaccaacgtggaaacgcgtaaccggaccgtaaaccgtacggtttacccttttaagtacgtggtacgggacgtaacgtaaggttacgttacgggtacgggggttccggggttaaccccggggacccttaccggtaccccggtttaggtttaacccgttaacggtccgtaagttcccggtaccgggtcgggggtcccgttacccgg

SEQ ID NO: 409503 - DNA, 621 bp, Homo sapiens
  misc_feature: GZ8MTXP02JRE4U.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatcgctacgtcgggtcccgccaggcctccgaggggaacggggctgggagtgggtctcgtagttattacaattcgtaggtaccactactacctaccgtcccggaccccgtaggaaccggggtcctaattaacccgattcctaccagtaacgacgtaacgttccgaagtaaactcgggtagtactacttacaaaatacgaaacaacctggacgagacccgaacgacgaccggtaccgtttatacgtgtacgacgagacgagtttacgacgggtcgggttaccggggacctccgtaacccgttggttaacctacgttcgactcgtcgtcgggggtccgtcgg

SEQ ID NO: 409504 - DNA, 720 bp, Homo sapiens
  misc_feature: GZ8MTXP02H1HK3.3.82.H05.1.454.CMB.2.raw
  modified_base (296)..(296): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgcaggtggtggagactgggaggaggcttgatccgaggccggtcgggggtccctggacgtactctcctgtgcagcctcgtggccttcaccgtcagtacgcagctacntcgctacgtcggtcccgaccgaggtaccgtacggaggggaacgggtcgtagggaggttcgggtctacgtagtttacttaactacgtttaccgtacgtaaccactactacccgttacccgtccccggaaccccggtaggtaaaccgggacccgtaaacttacccgacttacccacgtaaggaacgtaccgtacgttacccggaacgtaaaacgtacgggtacttaactacttaactaaagtaccgaaaacctacggtagacggaaccgaccggtaacgtaacgttaccgggttactttaactcggtagtacgaccggtaagtagtaacggtttcgggacggtttaccggggtccgggtaaccctccggttaacccgttgttccgtacgttacgtacgttccggtccggttcggggtacccgtcgg

SEQ ID NO: 409505 - DNA, 596 bp, Homo sapiens
  misc_feature: GZ8MTXP02FLPCZ.3.82.H05.1.454.CMB.2.raw
  modified_base (464)..(464): a, c, t, g, unknown or other
  modified_base (483)..(483): a, c, t, g, unknown or other
  modified_base (518)..(518): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtcccgccgaggcctaccgaggggaaggggctgggaggtgggtctcgtagttatttacaatttcgtaggtaccactactaccttacgtccccgacccccgtaggaaacggggtacccgaactttaaacccatcctaccagaacgacgattccgaagaaccaggtgtatcttanaaatcgaaacacgtgaganaccgacgacacggtactttatactgtgacgagagnttacggaggttcgggttaccgggacctccgtacccgttggttcctaacgtttcgactccgtacgcgggggtccgtcgg

SEQ ID NO: 409506 - DNA, 714 bp, Homo sapiens
  misc_feature: GZ8MTXP02IQKEV.3.82.H05.1.454.CMB.2.raw
  modified_base (276)..(276): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagggtggtggagactggaggaggcttgatccgagccgtgggggtccctgacgactctcctgtgcagcctcgtggtctcgaccgtnagtagcagctacatgccacgtcgggccgccgaggctacggaggggagggtcgtgggagttcgggtctacgtagtttactttacaagtttccgtacggtacctactacgttaccacccgttcccggaccccgtaggaaaccggtccgtaaacttaccatacctacgagtacgacgtatcccggaaagaccgtaccggtagttaacttacgtaacaaagtaccggaaaccgtaacccggaggacgaccccgtaacgggaaaccgttcccgggttaccgtttaagttaccgtggttaccggaacgtaggaacggtttacgttccgggaagggtttacccggggttaccggggacccttaccggttaaacccgttcggtttaaccctaacggttacctacgttcccggtcggggttcccggggtaccgtacggttcccccgg

SEQ ID NO: 409507 - DNA, 624 bp, Homo sapiens
  misc_feature: GZ8MTXP02G2JPT.3.82.H05.1.454.CMB.2.raw
  modified_base (281)..(281): a, c, t, g, unknown or other
  modified_base (585)..(585): a, c, t, g, unknown or other
  modified_base (622)..(622): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagcccgtgggggtccctgacgactctcctgtgcagcctcgtggcttccaccgtcagtacncagctacatcgcacgtcggccgccgaggcctaccggaggggagggctagggagtggtctacgtagttactttacacttcgtacgtaccactactaccgtacctcccggacccgtaggaacggggacctaacgttaaccattccaccgagaacggtacagttacccggaagtaaaccctgggtattaactccttaaagaaaattacggaaaccctaaacgtggaacgtaccgaccgaaacgaccgtacggtaccggtttatacgtgagacgagtagtacgttcggaggttcgggtaccgctaccnccgttgtaactcgtcgactccgtcggcggggtacccncg

SEQ ID NO: 409508 - DNA, 760 bp, Homo sapiens
  misc_feature: GZ8MTXP02FPHZM.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtgggaggaggcttgactccagccgtcgggggtcctgagactctcctgtcgcagcctcgtggtcttcgaccgtcagtagcagctacatgccacgtcggtccgccgaggcctacggaggggacggggtcgtgggtaggtcgggtctacgtagtttaactttacgtactttcgtacggtacctactactacccttaccgtcccggtacccgtagggaaaccggtccgtaacttaaacccgtatcctacccgaagtaacggacgtaacgttcccggaaaagtaaccccgtagggttacttaacttaaccgttaacaaaacgttaccggaaaacctaaacccggtagggaaaccgaccggaaccccgggaaacgtaacccggtaaccgggtttaccttttaacgttaaccgtgggtacggacggtaaggaacgttacgtttcgggtaaacgggggtttcggggtaacccggggtaccctacccggttaccgtttacgggttaacccttaacccggttcgttaccgtcccgtttaccggggccgggggttacccgttcccg

SEQ ID NO: 409509 - DNA, 720 bp, Homo sapiens
  misc_feature: GZ8MTXP02G3JYO.3.82.H05.1.454.CMB.2.raw
  modified_base (277)..(277): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactgggaggaggcttgatccgagccgtgggggtccctgagtactctcctgtgcacgtcctcgtcggcttcaccgtnagtgcagctacatgcacgtcggtccgccgaggcctaccggaggggagggcgtgggaggtgggtctcgtaaggtttaactttacaacttcgtacgtacccacgtaactaccgttacctccccggaacccccgtagggaaaccggggtacctaaacgtttaaacccacgttaccctacccgaaaggaaccggtaacgtaacggtttaacccgaaacgtaaacgtaccgggttagttaaccttaccttacaaaaacgtaacggtaaaacccgaaaccgttaggaaacggaccggacccggaaaccgtaaccggtaccggttaccgttttaatacgtggtaggaccgaaggtagtacgttacgggacgggttacgggtaccggggtaccttccgtacccgtttggtaaccttacttcggtactccggttcggtcgggggcccttcgg

SEQ ID NO: 409510 - DNA, 844 bp, Homo sapiens
  misc_feature: GZ8MTXP02F2WDU.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtcctgagactctcctgtgcagcctcgtggcttcaccgtcagtagcagctacatgcacgtcgggtccgccgaggcctaccggaaggggacggggcgtggggaggtcggggttctacgtaagtttaactttaactaacgtttcgtacggtaaccaacgtactaaccttacccgtccccggaacccccggtagggaaaccggggtaccccgtaaactttaaacccgacttcccgttacccgaaaggtaaccgtaaccggtaaacgtttaccccgggaaagtaaaacccgtacccgggggtttataaacctttaccgttaaaacaaaaacgtttaaccggaaaaccctaaacccggttagggaaacgaacccgggaaccccggtaaaaccgaaacccggttaacccggggttacccgttttttaaagttaaccgttgggttaacggacccggtaaaggtaaacggttacggttttacgggggtacggggtttaccggggggtttacccgggaaaccccgtttcccgtaacccccggttttgggttaaccctttaaccggtttaccgggtacgttcccgtttaccgggggtacggggggttccccgtttacccgggg

SEQ ID NO: 409511 - DNA, 659 bp, Homo sapiens
  misc_feature: GZ8MTXP02I8G2W.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctcgtggcttcaccgtcagtagcagctacatgccacgtcgggtccgccgaggcctaccggaggggaaggggctagggaggtcgggtctacgtagtttatttacgaactttcgtacggtacccaacgtacttacctacctcccggacccccgtaggaaaccgggtcctaacttaaacccgacttcccgtaccaaggaacgtaaccgtacgttacccggaaagaaaccgccgggttataacgttccttaacaaaacttacggaaaccaaacgtgaagacgacccggtaacgaccgtacggtaccttttaatacgtgtagacgaaggtacgtagttacggaggttcgggtaccgggacctccgtaccgttggttaacctacgttcgactcgtacggtcggggcctcgg

SEQ ID NO: 409512 - DNA, 528 bp, Homo sapiens
  misc_feature: GZ8MTXP02FENQ5.3.82.H05.1.454.CMB.2.raw
  modified_base (432)..(432): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttcctgttgctatttcaaaaggtgtccagtgtgaggtgcaggtggtggagactggaggaggcttgatccagccgtggggggtccctgagactctcctgtgcagcctctggcttcaccgtcagtagcagctacatgcactgggtccgccaggctccgaggggaaggggctgggagtgggctcagttatttacaattctggtaccacatacctactcccgacccgtgaaggccgattaaccatctccagagacgattccgagaacacggtgatctacaaatnaacaacctgagagcccgagacacggccgttatactgtgcgagagatcgagtcggttcggggactcaacccgtggttctactcgatcgtcgtcgggg

SEQ ID NO: 409513 - DNA, 726 bp, Homo sapiens
  misc_feature: GZ8MTXP02FRH8Q.3.82.H05.1.454.CMB.2.raw
  modified_base (296)..(296): a, c, t, g, unknown or other
  modified_base (316)..(316): a, c, t, g, unknown or other
  modified_base (320)..(320): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctattcaaaggtgtccagtgtgaggtgcaggtggtggagactggaggaggcttgatccagccgtgggggtccctgagactctcctgtgcagcctctggtcttcaccgtcagtagcagctacatcgcacgtgggtccncaggctccgaggggagggcngggngtggggtcacgtagtttaacttactaacttctaggtaccactataccctactcccggaccccgtaggaaacgggaccgtaacttaaaccgacttaccctaccagtaacggacgtaacgtttacccgaaaggtaaccgaccgggttagttaacttacctttaaacaaaacgtttacgaaaaacctaacccgttaggaaacgtacggaaccccgggaacgaaacccgtaccgggttaacccgttttaagttaaccgttggtacggaccgtaagtaaacgtacggttacgggtacggttacgggggtttacccggggtaaccccttcccgtaacccggtttcgggtttaacccttaaccgtttccgggtactttccgggtaccggttccgggggtacccggtttccggg

SEQ ID NO: 409514 - DNA, 928 bp, Homo sapiens
  misc_feature: GZ8MTXP02IZLIY.3.82.H05.1.454.CMB.2.raw
  modified_base (299)..(299): a, c, t, g, unknown or other
tcagagacgcactccacgaccggtgctcgatttagtcgagctctctcgcgggggggagaggaggccagcactgggattccgaggtgtttccattcggtgatcagcactgaacacagaggactcaccatggagttttggctgagctgggtttccttgttgctattcaaaaggtgtccagtgtgaggtgcaggtggtggagacgtggaggaggcttgatccagccgtgggggtcctgagactctcctgtgcagcctctggcttcaccgtcagtagcagctaacatcgccacgtcgggtccnccgaggcctaccggaggggaacggggtccgtaggggtacggttcggggttccttacgtaagtttaactttaacgaaacttttccgtacgggttaaaccctaaccttaacgttaaccccgttaacccgttcccccggggaaacccccccgggttagggtaaaaccggggggtccccctaaaaccgtttaaaaccccggaactttaccccgtaacccgaaaggtaaaccggtaaacccggtaaaaccgtttaccccggggaaaacggtaaaaacccgtacccgggggtttaaagtttaaccgtttaaccgtttaaaccaaaaaacgtttaccgggaaaaaacccctaaacccgttaaggggaaaccggtaaacccgggtaccccgggaaacccgtaaaaccggttacccgggggttaaaccccttttttaagttaaacccggtgggttaacccggtacgggaaaaggtaccggttaaaggttttaccggtaaacgggggtttccggggtttaacccgggggaaccctttacccggtaaaccccgttttcggggtttaacctttaaccccggtttacggtaaccgtttacccggtaccgggtttaccggggggtaccccgtttacccggggg

SEQ ID NO: 409515 - DNA, 718 bp, Homo sapiens
  misc_feature: GZ8MTXP02JL3OF.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttacaaaaggtgtccagtgtgaggtgcaggtggtggagacgtggaggaggcttgatccgagccgtgggggtccctgagactctcctgtgcacgcctcgtggcttcaccgtcagtacgcagctacatgcacgtcgggtcccgccgacggcctaccggaggggaacggggcgtgggaggtcgggtctacgtagtttactttaactaatttcgtacggtaacctacgtaacttaccgttaccgtacccggtaacccccggtagggaaaccgggtaccgtaaacttaaaccctagttaccctacccgaagaacgtacgtacgttaccgacgaaaccgtacggttactaacttacttaaacaaacgtacgtaaaacccgaacgtaggaaccgaaccgacccgaacgtacccggaacggttccgttttaacgtaaccgtgtacggtacgtaaggtacgttacggttcggtaagggtttccggggtacccgggtaccttacccggtaacccgttcggtttacccttacgtacgtaactttccggccggtttccggggg

SEQ ID NO: 409516 - DNA, 683 bp, Homo sapiens
  misc_feature: GZ8MTXP02FKAQ2.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtggtccgcaggcctccgaggggaggggctgggaggtgggtctcgtagtttatttactaacttcgtacggtaccacgtaactaccttaccgtcccggaacccccgtagggaaacggggtcccgtaaactttaaacccacttccgtaacccgaaggaaacggtaccgtaacgtttacccggaaagtaaaccgtacgggttacgttaacttacttaaccgaaaattacggaaaaccaaaccgtgaaagaccgaccggaacgaccgacggttccgtttaatacgtgtagacgaggtaagtacgtttacggacggttcggggtaccggggacccttacggacccgtttcgggtaacttaccgttccggacttccggtccggtcgggggacccggtccgg

SEQ ID NO: 409517 - DNA, 689 bp, Homo sapiens
  misc_feature: GZ8MTXP02GEI4M.3.82.H05.1.454.CMB.2.raw
  modified_base (518)..(518): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgcgaggtggtggagacgtgggaggaggcttgatccaggccggtcgggggtcctgagactctcctgtgcacgcctcgtggtcttcaccgtcagtagcagctacatgcacgtcgggtccgccgaggccgtccggaagggggaacggggtcgtggggtaggttcggggttactacgtaggtttaactttacgtaactttccgtacggtaacccactacttaacccttaccgtccccggtaccccggtaggaaaccggggtacccgtaactttaaaccgacttaccgtaccgagaacgtacgtaacgttaccggaacgaaacgtacgggttntaacttacttaacgaaaacttacgaaacctacgtagacgacgaccggaacgtaccgacggttactttaactcgtgtacgacgtagtaacgtacgttcggaggttcggggtccgggtacctccgtaccgttggttcctacgtcgtacttcggtacggtcggggtcgttccgg

SEQ ID NO: 409518 - DNA, 789 bp, Homo sapiens
  misc_feature: GZ8MTXP02GFXNC.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcacgcctcgtggtcttcaccgtcagtagcagctacatgcacgtcgggtccgcgacggtcctaccggaaggggaacggggtccgtaggggacggttcggggttctacgtaggtttaactttacgtaactttccgtacggtaacccaactaacttaaccgttaacccgtccccgggtaacccccggttagggaaaccggggtaccgtaaaccgtttaaaccctacttacccgtacccgaaggtaaccggtaacccgtaacgtttcccggaaaagtaaccgtacccgggttagttaaacctttaccgttaaaccaaaacgtttacggaaaaaccctaaccgttagggaaaccgtaccgaaccccgggaacgtaacccgtaccgggtttacgtttttaacgtaacgtcggttacgacgtaaggtaagttacgtttacgggacgggtttacggggtacccggggaaccctttccgtaaccccggttggttaaccctttacggttacggactttccggtaccggtcgggggtaccctttccgggg

SEQ ID NO: 409519 - DNA, 648 bp, Homo sapiens
  misc_feature: GZ8MTXP02JMPBY.3.82.H05.1.454.CMB.2.raw
  modified_base (479)..(479): a, c, t, g, unknown or other
  modified_base (494)..(494): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaggtgtcagtgtgaggtgcaggtggtggagacgtggaggaggcttgatccagccgtgggggtccctgagctctctgtgcagtcctcgtcggtcttcaccgtcagtacgcagctacatcgcacgtcgggtccgcgacggctaccggaggggaacggggtcgtagggaggtcggggtactcgtaagtttaactttaactacgtttcgtacggtaccactactacccttacgtcccggacccgtagggaacgggaccctaacttaaccacttccaccgaagacggactacgttaccgaagtaccgtacggtnttaacgtaccttaanaaatacggaaaccaacgtggacgacgaccgaaagaccgtcgggttacttagtactggacgacgaggtaagtgtaccgggagggttcggttaccgggaccctcgtacccgtttggtaacctcggttacgacgtcggtccggacgggggccttcgg

SEQ ID NO: 409520 - DNA, 647 bp, Homo sapiens
  misc_feature: GZ8MTXP02G7CWO.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtcctgagactctcctgtgcagcctctggcttcaccgtcagtgcagctacatgaccacgtcgggtcccgccgaggcctaccggaggggaacggggctgggaggtggggtctacgtaggttatttacaacttcgtagtaccactatacctactcccgacccgtagaacgggcctaacttaaccactcctaccgagacgacgtactaccgaagacgtacggtgtactacttacaaaatcgaaacaaccgtagaacggacgaccggaacgacccgtacgggtccctttaatacgtgtacgcgaaggtacgtagtttaccggagggttacggggttaccggggacccttaaccgtccccgtttacgggtttaacctaacgtttaccggtacttccggttccggtacgggggtccctccggg

SEQ ID NO: 409521 - DNA, 669 bp, Homo sapiens
  misc_feature: GZ8MTXP02JETCD.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtcctgagactctcctgtgcagcctctggcttcaccgtcagtagcagctacatgcacgtcgggtccgccgaggcctaccggaggggaacggggcgtcgggaggtcgggtctacgtagtttactttacaacgtttcgtcggtaaccactactaaccttaccgtcccggtaccccgtaggaaaccggggtacccgtaaacttaaccctactcctacccgaggtaacgtaaccgtacgtttaccggaaagtaaaccgtacggggtacttaacgttaccttaacaaaagttacgaaacctaaaccgtggaacgacgaccgaacgacgtacgtaccgtttatcgtgtagacgagtacgtacgtcggaacggttcgggtaccgggtaccttccgaccgtttcggttaaccttacgtcgtacgtcgtacggtccggggtcctccgg

SEQ ID NO: 409522 - DNA, 654 bp, Homo sapiens
  misc_feature: GZ8MTXP02F7EE1.3.82.H05.1.454.CMB.2.raw
  modified_base (303)..(303): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtgggaggaggcttgatccagccgtgggggtccctgagactctcctgtgcagcctctggcttcaccgtcagtagcagctacatgcacgtcgggtccnccgaggctccgaggggaaggggctgggagtgggtctctagttattacattctaggtaccactatctactcccgacccgtgaacgggcgtaactaaccatctaccgagaacgacgtattaccggagaaacgtaccggttagtactactttaacaaaagttacgaaaacctaaacccgtggaaacggaccggacccgaacggaaccgtaacgggttaccctttaagttaaccgtggttacgacggtaaagtacggtacgttaccgggaaggtttcgggggttaccgggggacccttaccgtaaccccggttggtttaccttaccgttcgtacgttccgtcgggttcccggggg

SEQ ID NO: 409523 - DNA, 644 bp, Homo sapiens
  misc_feature: GZ8MTXP02JNLCG.3.82.H05.1.454.CMB.2.raw
  modified_base (436)..(436): a, c, t, g, unknown or other
  modified_base (475)..(475): a, c, t, g, unknown or other
  modified_base (486)..(486): a, c, t, g, unknown or other
  modified_base (545)..(545): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtggaggaggcttgatccgagccgtgggggtccctgacgactctcctgtgcagcctcgtggccttcaccgtcagtagcagctacatgcacgtcgggtcccgccgaggccgtacccggaagggggaacggggtcgtgggaggtcggggtctacgtagtttacttactattcgtacggtacccactatacctaccgtcccggaacccgtgaacgggtccgtaacttaacccngtcctacgagacgacgtacttaccgagaacgtacgggtntataccgttanaaaagttcaaaaccaccgtagacgtacgacccgaacgacgtaccggttctttaattcgngtacgcgtagactacggttggacggttacggggttacccggcccttacgtaaccggttcggttacctaccggttcgacgttcccggtacggtccggggg

SEQ ID NO: 409524 - DNA, 714 bp, Homo sapiens
  misc_feature: GZ8MTXP02FLTXE.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttacaaaaggtgtccagtgtgaggtgcaggtggtggagacgtgggaggaggtcttgatccgacggccgggtcgggggtccctgacgacctctccgtgtgcacgcctcgtggtcttccaccgtcagtacgcagtactacagtcgacctacggtcgggtccccgacgacggtccgtaccggaagggggtaacggggcgtggggtagggttcggggtactacgttaagtttaactttaacgtaacttcgtacggtaaaccaactaacgttcctaacccgtaccccggacccggtaggaaaccgggacctaaacgttaacctactacctacgagtaacgacgtacttaccgaaacgactacggttagtacttacgtaaaacaacgtaacgaaaccgtacgtggaacgaccgaccgaaccgaacgtaccgggtttaacttacgtacgtgtacgacgtaagagttacggtacggttagggtaccgggttaccgggaccctttacccggtaacgttcggtttacctcggtactcgtccggtcgggttcccgggg

SEQ ID NO: 409525 - DNA, 843 bp, Homo sapiens
  misc_feature: GZ8MTXP02FYQWV.3.82.H05.1.454.CMB.2.raw
  modified_base (278)..(278): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctattcaaaaggtgtccagtgtgaggtgcaggtggtggagactggaggaggcttgatccgaggccgtggggggtccctgagactctcctgtgcacgcctctggcttcaccgtcagtancagctacatgctacgtcgggtcccgccgaggcctccggaaggggaggggcgtgggaggtggggtactcgtagtttaatttacaacgtttcgtacggtaaccactacgttaacccttaccgtaccccggtaacccccggtaggtaaacggggcccgtaaacttaaacccgattaccctaccgaaggtaaacggaaccgtaacgtttacccggaaaagtaaacccgtacggggttacgttaactttaccttaaaccgaaaagttaaccgaaaacccgtaaaccgtggaaagaaacccgggaccccgggaaacggtaacccgtaaccggggtttaaccccgtttttaaagttacccggttaggttacggtaccgggtaaaaggtaacggtaacgggtttaccgggggtaacgggggtttacccgggggttttaacccggggggtaaccccctttacccggtaacccccggtttttacgggggtttaacccttttaacccggtttaccggtaaccgttttccccggtttaccggggttaccccgggggggtcccggtttaccccggggg

SEQ ID NO: 409526 - DNA, 679 bp, Homo sapiens
  misc_feature: GZ8MTXP02IGV3K.3.82.H05.1.454.CMB.2.raw
  modified_base (282)..(282): a, c, t, g, unknown or other
  modified_base (581)..(581): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtgggaggaggcttgatccagtcgtgggggtcctgagactctctgtgcagcctctggcttcacgtcagtagcagctanatgctacgtcggtccgccgaggccgtaccggaggggaaggggctgggaggtcgggtctacgtagtttacttactacgtttcgtacggtaaccactacttacccttacctccccgggtacccccgttaggaaaccggggtccctaacgtttaaaccactaccgtacccgaagtacgtaacggtaccttaccggaaagtaaaccgtacggttagttactaccgttaaacaaaagtaccggaaaacctaaccgtggaacgaccgacccggaacgtaccgtaccggttaccgtttattaccgngtacgacggagtacgtaggttacgacgggttcgggtaccgggacctaccgttaccgttgtaaccttacgtcgtacttcgtccggtacggggccctcgg

SEQ ID NO: 409527 - DNA, 666 bp, Homo sapiens
  misc_feature: GZ8MTXP02GYEXF.3.82.H05.1.454.CMB.2.raw
  modified_base (273)..(273): a, c, t, g, unknown or other
  modified_base (278)..(278): a, c, t, g, unknown or other
  modified_base (575)..(575): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgcttatttcaaaaggtgtccagtgtgaggtgcaggtggtggagactgggaggaggcttgatccagccgtgggggtccctgacgactctcctgtgcacgcctctggcttcaccgtnagtancagctacatgacctacgtcgggtccgccgtagggcctaccggaaggggtaacggggccgtaggggacggtttaggggtcctacgtaggtttaatttaaccaacgtttccgtacggtacccataacttacctaaccgtcccgtaccccggtaggaaaccggggtacctaacttaaccgcttacctaccgaagaacggactacgttaccggaaagaacgtaccggttatacgttctaaacaaagttacggaaactaaaccgtgaaacgcacccggaacgacaacggtcctttaattacngtgacgagtacgtacttggagttcgggtacggacctcctaacccgttggtaaccttcgttacgacgtttcgaccggttcggggactccggg

SEQ ID NO: 409528 - DNA, 728 bp, Homo sapiens
  misc_feature: GZ8MTXP02GAICA.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctattcaaaaggtgtccagtgtgaggtgcaggtggtggagactgggaggaggcttgatccgagccgtgggggtccctgagactctcctgtgcagcctctggcttcgaccgtcagtgcagctacatgcacgtcgggccgccgaggcctaccggaaggggaacgggtcgtgggaggtcgggtactccgtaaggtttatttacaacctttcgtacggtaacctaacgtacttaaccgtaaccgttccccgacccccggtaggaaaccggggtaccctaaattaaacccgatacccgtacccaaggaacgtaaccgtaacgttacccggaaagtaaaccgtacggggttacttaacttaccgttaaacgaaaaacgttacaaaaacccgtaaaccgtggaaacgaaccggacccgggtaacgaacccgtaccgggttaccgttttaacttaaccgttggaccgtacggtaagtacggtacggtttacggaacggggttcgggtttaaccggggacccttaccgtaccgttacggtcctaaacggttccgtatccgttcggcggggtcctcgg

SEQ ID NO: 409529 - DNA, 732 bp, Homo sapiens
  misc_feature: GZ8MTXP02FU8ZM.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtgggaggaggcttgatccagccgtgggggtccctgagactctcctgtgcagcctctggtcttcgaccgtcagtagcagctacatgcacgtgggtcccgccgaggcctaccggaggggaacggggctaggggaggttcggggtctacgtaagtttactttaactaatttccgtacggtaacccaactaactaaccttaacccgtcccggtaacccccgtagggaaacggggtaccccgtaactttaaaacccacttcccgtacccgaaaggaacgtaaaccgtacgtttacccggaaagtaaacgaccgggttgttaaacttcctttaaacgaaaacttacggaaaaaccctaacccgttaggaaacgaccggaacccggaaaccgaacccggtaacggttacccgttttaagttaccgttggacgtaccgggaagtacgtacgtttcggacgggtttcggggtaccgggtaccctacgtcccgttaggttcctacgttacgtactcgttccggtcggggacccgtcgg

SEQ ID NO: 409530 - DNA, 802 bp, Homo sapiens
  misc_feature: GZ8MTXP02F2ZNT.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagtttggctgagctgggttttccttgttgctattcaaaggtgtccagtgtgaggtgcaggtggtggagacgtggaggaggcttgatccagtcgtgggggtcctgagactctcctgtgcagcctcgtggcttcaccgtcagtagcagctacatcgacacgtcgggtccgccgaggtcctcccgaaggggaagggggcctggggacggtggggtcctcgtagtttaacgtttaacaaactttccgtacgggtaaccaacgtaacttaacccgttaacccttccccgggaaaccccccggttagggaaaccgggggtaccccgtaaaacgtttaaacccgaacttacccgtaaccgaaacggtaaacggaacccgtaaacgtttacccggaaaaggtaaaacccgacggggtttaacgttaacttaccctttaaacaaaaacgttacggaaaaccctaaacccgttaggaacggaccggaacccggaaaccgaaccccgtaacggggttacccgttttaaacgttaaccgttcggttagaaccgggaagaaggttaacgtttccggtaaagggggtttcggggttaccggggtacccgttaccgaccccggtttacggttaaccgtttaccgttaccgtacgtttcccgtcggtccgggggtaccgttcccgggg

SEQ ID NO: 409531 - DNA, 739 bp, Homo sapiens
  misc_feature: GZ8MTXP02HJ2ZP.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagtcttggggtttttccttgttgcttatttacaaaaggtgtccagtgtgaggtgcaggtggtggagacgtggaggaggcttgatccagccgtcgggggtcctgagactctcctgtgcacgcctcgtggccttccaccgtcagtagcagctacatcgccacgtcgggtcccgccgacggccgtaccggaagggggaacggggcgtagggaggttcgggtctacgttaagtttaactttaactaactttcgtacggtaaccactacttaaccttaccgtccccgtaaccccggtaggaaaccgggacctaaacttaaccactcctaccgaaagacgtaacgtaacttacccggaaagtaaacgtacggttattaaacttacttaaacgaaaacttaacggaaacctaaaccgtggaaacgaccggacccgtaaacgaacgtacccgggttacctttaagtacgtgggtacgacggtaaacgtagtacggtttcgggacggtttaccgggggttacccgggtacccttacccgtacccggtttacggtttaaccctaacgttccgtacgttccgttcggggtaccgggggtccgtacccgg

SEQ ID NO: 409532 - DNA, 561 bp, Homo sapiens
  misc_feature: GZ8MTXP02GNTDK.3.82.H05.1.454.CMB.2.raw
  modified_base (350)..(350): a, c, t, g, unknown or other
  modified_base (357)..(357): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcactgggtccgccaggctccgaggggaaggggctgggagtggggtctcagttatttacaattcngtaccanatactactccgacccgtgaagggccattaaccatctccagacgacgattccgagaaacacggtatactcttacaaatcgaaacaacctgagagccgaacgacacggtaccgtttatacgtgtagacgagtagtacttaggacggtcgggttacgggacctcgacccgtggttctacgttcgactctacggtcgggggtcctcgg

SEQ ID NO: 409533 - DNA, 711 bp, Homo sapiens
  misc_feature: GZ8MTXP02JIMGJ.3.82.H05.1.454.CMB.2.raw
  modified_base (274)..(274): a, c, t, g, unknown or other
  modified_base (301)..(301): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtggaggaggcttgatccacgccgtgggggtcctgacgactctctgtgcagcctcgtggccttcgaccgtnagtagcagctacatcgcacgtggtccncgaggctcgagggagggcgtaggagtggtctcgtagttattacagttctcggtaccactactacctacgtcccgtaccgtaggaaacgggcctaacttaacccgatcccgtaccgagaacggtacgtaacgttacccgaaggtaaaccgacgggttaacgttacgtaccttaaactaaacgttaacgaaacccttaaacgtacgggagaaccccggaacggacccgaaccggtaaccgggtttaccgtttaagttaccggtacggtacggtacggaacgtaaggttaccgttacggggtaacgggtttcggggttaacccgggggtaccctttaccggtacccggttcggtttaacccgttcggttaccgtacggttccgtacgggttccggggtcccggttaacccggg

SEQ ID NO: 409534 - DNA, 649 bp, Homo sapiens
  misc_feature: GZ8MTXP02GLUVT.3.82.H05.1.454.CMB.2.raw
  modified_base (300)..(300): a, c, t, g, unknown or other
  modified_base (456)..(456): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccagccgtggggggtccctgagactctcctgtgcagcctctggcttcaccgtcagtagcagctacatgcacgtcgggccnccgaggctaccgaggggacggggctgggagtgggtctcgtagtttaattactaacttcgtacgtaccactatacctactcccgacccgtaggaacgggcctaacttaaccactcctaccgaagaacgacgtacttaccggaagaaacgtacggttntaacttccgttaacaaaattacgaaacctaaccgtggaacgacgacccggtaacgaccgtacggtaccgttttaatcgtcgtagacgagtacgtacgttacggacggttcggggttaccgggacccttaccggtacccgtttcggttaaccttaacgttcgtacgttccggtcggtcgggggtaccctccggg

SEQ ID NO: 409535 - DNA, 761 bp, Homo sapiens
  misc_feature: GZ8MTXP02IYCYT.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtgggaggaggcttgatccgagccgtggggggtccctgagactctcctgtgcagcctctggcttcaccgtcagtagcagctacatgccacgtcgggtcccgaccgacggccctaccggaagggggaacggggtccggtagggtaggttggggttacctcgttaagtttaaacgttttaactaacgtttaccgttacggtaaccctaaacgtaacgtttaacccttaacccccgttaccccgggaaccccccgggttaaggggtaaacccgggggtacccgtaaacccgtttaaaaccctacgttaccctacccgaaaggtaaccggtaaccgtaacgttaccccgggaaaacgtaaaccgtacggggtttacttaacttacctttaacgaaaacttacggaaaacctaaccgtagaacgtacgaccgaacgacccgtacgttcgtttaatacgtgtacgagtagtacgtacgttgggtacggttcggggttaccggaccttaccgtacccgtttcgtccgttacgttacgtacgttccgtcggtcggggccgtacgg

SEQ ID NO: 409536 - DNA, 622 bp, Homo sapiens
  misc_feature: GZ8MTXP02HKX00.3.82.H05.1.454.CMB.2.raw
  modified_base (247)..(247): a, c, t, g, unknown or other
  modified_base (376)..(376): a, c, t, g, unknown or other
  modified_base (596)..(596): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctggtaggggacaggagtcgctagtgtacgttggtcgggcgtaccgtcggttacggttttaanagtagttggttagtcgtggtatcagacgaaagaaaccggagggaaaccgccccgttagacgttacctaatcgtctgctgcctactcccacctgactaaaggtcggactcccgatcgatctcgagcgtanagtagatcggtaggacagtcgtacacctctaccacactccacgccacgccctgccacgtccgtaaggtaagttctttaacgacttaaacttacgtttatcgtacgaaagtcggtactacgaccgtacggtccctccgtaccgtaccgttaccggttaccgggacggggtaaaccgggaaaccggttaaggggacgaacgttaaccgaacgtaaaaccggngtacggtcgacgtcgacctactaccg

SEQ ID NO: 409537 - DNA, 639 bp, Homo sapiens
  misc_feature: GZ8MTXP02GHNXH.3.82.H05.1.454.CMB.2.raw
  modified_base (505)..(505): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgcgaggtggtggagacgtgggaggagcttgatccaggccgtgggggtccctggagactctcctgtgcacgtcctgtcggtccttcgaccgtcagtagcagctacatgcacgtcgggtccgccgaggcctaccggaggggaacgggcgtgggaggtgggtctacgtagtttatttacacttcgtacgtacactacttacctcctcccggtacccggtaggaaccgggtaccgtaacttaaccgacttcctaaccgagaacgtacgtacgttaccgaagtacgaccgttgtaactactaacaatacgaaactaacgngaacgaccgacgaacgaccgtacggttaccgtttatacgtgtacgagtacgtagtagtacggtcggttcgggtaccggactccgtaccgttggttaacctacgttcggtactccggtcggtcggggaccctcgg

SEQ ID NO: 409538 - DNA, 644 bp, Homo sapiens
  misc_feature: GZ8MTXP02H2SL2.3.82.H05.1.454.CMB.2.raw
  modified_base (298)..(298): a, c, t, g, unknown or other
  modified_base (339)..(339): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcacatggagttttggctgagcgttgggttttccttgttgcttatttacaaaaggtgtccagtgtgaggtgcaggtggtgagacgtggaggaggcttgatccgagccggtgggggtccctggacgtactctccgtgtgcacgcctcgtcggtctccgacgtcagtacgcagctanatgactcgtcggcccgcgacggcgtcggaagggagggtcgnggagtggtctagtagttacttactagttcgtacgtacctatactacctaccgtacccggtacccgtagaaccggtcctaaacttaaccgacttccgacgagaacgtacgacgttacgaacgaacgtacggtacgtacttacctaagaaacttacgaaacctacgtagacgacgacgaccgacgttaccggtctttaaacgtgtacgtacgacgtaggtaacgttagttacggtaacgggtttcgggtacccgggtaccttccgtaacccgttggttacctacgtctacgtcgtttacggccgggg

SEQ ID NO: 409539 - DNA, 649 bp, Homo sapiens
  misc_feature: GZ8MTXP02JYLUK.3.82.H05.1.454.CMB.2.raw
  modified_base (301)..(301): a, c, t, g, unknown or other
  modified_base (319)..(319): a, c, t, g, unknown or other
  modified_base (379)..(379): a, c, t, g, unknown or other
  modified_base (383)..(383): a, c, t, g, unknown or other
  modified_base (420)..(420): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtcctccatcctccgtgtctgcatctggtaggggacagacgtcgctagtgtacgttggtcgggcgtacgtcggtaccggttttaaacagtagttggtttagtcgttggtatcagacaacggaaaccgagggaaacnccccgtagtacgtttccngtatgtctgctgccactcccaccgtgacgaaagtggactccatccagtctcagcgttacngtanaagtcgtagggactagtacgttccactctacacgtancgacgcacgcctagcgacgtcctaagaacgttactttacgaacttaactttacgttagttacgttaaaccgaacggtcgtaccgtacgtaccgtaccgttccccgtacccgttaccgttaccgttacccgggtttacggggaaccggggttaaaccgggaacccggtaaggggttacggaacgtaacgtaacccgtaaaaacggtcgtcggttacggggtactaaccgg

SEQ ID NO: 409540 - DNA, 696 bp, Homo sapiens
  misc_feature: GZ8MTXP02GO43I.3.82.H05.1.454.CMB.2.raw
  modified_base (301)..(301): a, c, t, g, unknown or other
  modified_base (483)..(483): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgtacgcctctggccttcaccgtcagtagcagctacatgcacgtcgggtcccnccgacggctccgaaggggaggggctgggaggtgggtctcgtaagtttattactaattccgtacgtaccactatacctaccgtcccgacccgtagaaacgggcctattaaacccatacctacccaaaggtacgaaccgtaacttaccggaagtaaaccgtacgggttgtaacttaccgttaanaaaacgtcgaaaacccaaccgtaggaacggaaccgacccggaacgtaaccgtaacccggttaccggttttaaataccgtagggtccgtagggaaacgtacgtacgttacgggtagggttccgggggttaccggggacccttcccgtacccggttacggtttacctaaccggttcgacgtttccgtacggtccgggggtcccgtcggtaccccg

SEQ ID NO: 409541 - DNA, 661 bp, Homo sapiens
  misc_feature: GZ8MTXP02IRQDH.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtggaggaggcttgatccagccgtgggggtcctgagactctcctgtgcagtcctcgtggcttcgaccgtcagtagcagctacatgcacgtcggtcccgccaggcctaccgaggggaacgggcgtagggcggtcggtctcgtaagtttacttacgtaatttcgtacggtaccacgtatacctaccgtaccccgtaaccccggtagaaaccgggtaccgaaactttaaacccgattccaacccgaagacgaacgtacttacgaacgtaaacgtcggtagttaactcttaacaaattcgaaaactacgagacgacgccggtaacgacgtacccggttacgtttaataccgtggtacgacgtaaggtagtacgtttcggaacgggtttcgggggtacccggtacctacccgtaaccgtttaggttacctacgttacgtacgttccgttcggtccggggg

SEQ ID NO: 409542 - DNA, 698 bp, Homo sapiens
  misc_feature: GZ8MTXP02JKQIS.3.82.H05.1.454.CMB.2.raw
  modified_base (270)..(270): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttggatccagccgtgggggtccctgagactctcctgtgcagcctctggcttcaccgtnagtgcagctacatgcacgtgggtccgccgaggccgtaccgaggggacggggcgtgggaggtggggtctacgtagtttaacttactaactttcgtacggtaccactactacctacctcccggaccccgtaggaacgggacccgtaattaaacccgatacctacccgaaggtaacgaccgtacgtttacccggaaagtaaaccgccggggttattaacttaccctttaaacgaaaagttacggaaaacctaaaccggttaggaacggaacgacccgggaaaccgtaaccgtacgggttacccttttaagtacgttacggtacgtcgaagtacggtagttaccgggaaggttcggggttacccgggaccttccgaccccggtttggttaaccctacgtttaccgattccgtcgggtacggggccgttccgg

SEQ ID NO: 409543 - DNA, 700 bp, Homo sapiens
  misc_feature: GZ8MTXP02JP8NL.3.82.H05.1.454.CMB.2.raw
  modified_base (346)..(346): a, c, t, g, unknown or other
  modified_base (408)..(408): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatcgacccagtcctccatccctccgtgtctgcatcgtaggtaggggacaggtagtcgactagtcgtacgttggtccgggacgtaccgttcggtacggttttaaacaggtagttggttagtcgtaggtactcgagacgaaacggaaaccgaagggaaacctccccgtagtacgtttccagtattcgtcgngtactcgacctacctcccgaccgtagaacgtaaaggtcggacctaccactccgagtactcgngtacgtactaggtacgtaagtcggagggactaacggtaccttaccacctccctaaccacctacacgaacggcctaccgtcgacgaccgacgttccgtaaaggttactttacgtttacaacctttaaatttaacgttagtaacgtaccgaaaggtcgtactaccgtacgtacccggttccctaccgttccgttaccgttacgggggtaccgggaacgggaaccgggtaacgtaggggtaaaccgaagtaaacccgtaaacggtaaaccggtggtacggtaccggactacccgg

SEQ ID NO: 409544 - DNA, 611 bp, Homo sapiens
  misc_feature: GZ8MTXP02GB03F.3.82.H05.1.454.CMB.2.raw
  modified_base (452)..(452): a, c, t, g, unknown or other
  modified_base (513)..(513): a, c, t, g, unknown or other
  modified_base (519)..(519): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctcgtggcttcaccgtcagtagcagctacatcgcacgtcggccgccaggcctaccggaggggaacgggcgtgggagtgggtcctagagtttatttacaactttcgtagtaccactatacctactcccgaccccgtagaaacggggcctaactaacattccaccgaagacacgtacgttaccgaaagtaccacggttntaactctaacaaatacgaaacacgtgaagacgacgaacgaccgtacggtcctttaatacgngtacgngagtagtgttaggacggttcgggttaccgggaccttccgtaccggtttaggttcctaacggttctacgtcgttcggtcggggtcccgttcgg

SEQ ID NO: 409545 - DNA, 548 bp, Homo sapiens
  misc_feature: GZ8MTXP02HG1XR.3.82.H05.1.454.CMB.2.raw
  modified_base (239)..(239): a, c, t, g, unknown or other
  modified_base (276)..(276): a, c, t, g, unknown or other
  modified_base (331)..(331): a, c, t, g, unknown or other
  modified_base (451)..(451): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcactcgtcggttttaacngattggttagtctggtatcagcagaaaccaggaaacncccctgagttcctgatgtctgctgcatcccacctgacaaagtgagtccatccagnttcagcgtcagtgaatcgtgggaacagagttcactctacacatcagcagcctgaccagactacgtaaagttagtttacactaaactttacttaattagtactaaacgaggtacagtaacncgtctaccccgctaccgttacgttccgggacgggtaacgggacctaaggggtacggaagaacgttaacgaaaaccgtaagttacggtcggactacgg

SEQ ID NO: 409546 - DNA, 724 bp, Homo sapiens
  misc_feature: GZ8MTXP02F45LK.3.82.H05.1.454.CMB.2.raw
  modified_base (259)..(259): a, c, t, g, unknown or other
  modified_base (534)..(534): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagggtggtggagacgtgggaggaggcttgactccgagccggtgggggtccctggacgactctcctgngcacgcctcgtggcttccaccgtcagtacgcagctacatgcacgtcgggtcccgcgacggccgtaccggaggggaagggcgtagggtacgtcggggtctacgttaagtttaacctttacgtaacgtttacgtacggttaaccaactaacgttaccctacccgtaccccggtacccggtacgggaaccgggtacgtaacttaaacccgacttccgaccgagaaacgaccgtaacgttacccggaacgtaaacggtacgttagttaactccttaaanaaacgtacgtaaaccgaacgtacggaagacgtcccgaaggtaaccgtacggttaccctttaagtactcgggactacgggagtaagtacggttcggtacgggtttccggggtacccgggtacccttacccggttaaccgtttacgggttaccttacggttaccgtacgttccggtacgggtttcccggggg

SEQ ID NO: 409547 - DNA, 741 bp, Homo sapiens
  misc_feature: GZ8MTXP02H9K9X.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactgggaggaggcttgatccgaggccgtgggggtccctgagactctcctgtgcagcctctggcttcaccgtcagtagcagctacatgccagtcgggtccgccgaggccgtaccggaggggaacggggcgtaggggaggttcggggtactacgtaagtttaatttacgaacgtttcgtacggtaacccacgtaactaccttaccgtccccggtaaccccggttaggaaaccgggggtaccctaaacgtttaaaccccgaactttcccgaacccgaaggtaaccgtaacccgtaactttacccgggaaagtaaaacccgtacggggttattaacctaccgtttaaacaaaattcggaaaacctaaccgtggaacggtacgacccggaacggaaccgtaccgggtaccgttttataacggttgtacggacgaaggtacgtacgtttacggacggtttacgggggtacccgggtaacctcccgttaacccggtggtttccctaacgttccgtaacgttccgtccggggtcggggtacccgtcggg

SEQ ID NO: 409548 - DNA, 699 bp, Homo sapiens
  misc_feature: GZ8MTXP02FPKJ6.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtcccgccgaggcctccggaggggaacggggctgggagtggggtctcgtagttactttacaattcgtcggtaaccacattacctacctcccggaccccgtgaacgggccgaattaacccactcctaccaagacgacgtagttacccggaagaaacgacgggttagtactaccttaacaaaacgtacgaaaacctaaaccgtaggaaacggtacgaccccggtaacgaaccgtaaccgggtacccgttttaattaccgtgtacggtacggaaggtacgtaacggtttaccggtaaacgggtttccgggggttacccgggggtacccctttaccgaacccccggttttaggggtttacccgtttaaccggtttccggtaacgttcccgtttcgggttcccgggggg

SEQ ID NO: 409549 - DNA, 810 bp, Homo sapiens
  misc_feature: GZ8MTXP02GZ1X6.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggtagttttggctgagcgtggtttcgtgtgctattacaaaggtgtcagtgtgaggtgcgaggtggtggagacgtggaggagcttgatccgaggccgtgggggtccctgacgtctctccgtgtcgcgcgccctcgtggtccttccgacccggttcagtacggccaaggtctaaccgcgtcgtacgtaccggtccgggtccggaccggacggtaccggtaccgggaacgggggtaacggggtcggtagggtacgggttcgggttaccgttacgttaacgtttaaacgtttaacgttaaccgttaccgttaccgtaaccgtaaccttaacgttaacccgttaacccgtaccccggtaacccgggtaaccgggtaaccgggtaacccgttaaccgttaaccgtacctacctaaccgtaacgtaacggtaaccgtaaccgtaacgtaacgtaacgtacgtacgttaacttactaactaaacgtaaacgtaaaccgtaacgacgacgacgaccgaaccgtaaccgtaccggttacgttacgttacggtaggtacggtacggtaaggtacggtacggttacgggtacgggttaccgggttacccgggttacccgttacccgttacccggtttacggttaaccgttacgttacgttacgtaccggttccgggttccggggtccggtaccgg

SEQ ID NO: 409550 - DNA, 627 bp, Homo sapiens
  misc_feature: GZ8MTXP02FNB8R.3.82.H05.1.454.CMB.2.raw
  modified_base (257)..(257): a, c, t, g, unknown or other
  modified_base (270)..(270): a, c, t, g, unknown or other
  modified_base (296)..(296): a, c, t, g, unknown or other
  modified_base (363)..(363): a, c, t, g, unknown or other
  modified_base (442)..(442): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagtttggctgagctgggtttccttgttgctatttcaaaaggtgtccagtgtgaggtgcaggtgtggagactggaggaggcttgatccagccgtggggggtccctgagactctcctgtgcagcctntggcttcaccgtnagtagcagctacatgcactgggtccncgaggctccgaggggaaggggctggggacgtgggtctcgtagttacctttacaattctaggtacccncaatcctactccgaccccgtgaacggcgattaaacccatcctaccagaacacgaattcccgaagaaaccgaacgggttntaacttactaaacaaacgtacgaaacctaacctaggaacgacgacccgtaaaccgaacgtaccggtacctttaaacgtacgtgtacggacgaagtacgtaacgttcggtaacgggttacggggttaccgggaacccttaccgaacccgttacggtttacctacgtcgtactccgtcggtcggggg

SEQ ID NO: 409551 - DNA, 709 bp, Homo sapiens
  misc_feature: GZ8MTXP02JN1XP.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtgggaggaggcttgatccgagccgtgggggtccctgacgactctccgtgtcgcagccgctggcttcaccgtcagtagcagctacatgcacgtcgggtcccgcgaggccgtaccggaggggacgggcgtgggaggtcgggtctacgtagtttactttactactttcgtacggtaaccactacttaccgtacccgtacccggtacccggtacggaaccggggtaccgtaaacttaaacccatccgtacccgaaggacggaaccttaacgttacccgaaaggtaaacccgtacggggttataacttacccttaaaaggaaacttacggaaaacctaaccgtaggaaacggaccggaacccgaacggtacttaccggggttcctttaagttacgcggtaggaacgtacgaaggtacgttacgggacggttcgggggtacccggtacccctacgttaacccggttcgttaccgttacgtacgtaactttcccggtcgggtcccgggg

SEQ ID NO: 409552 - DNA, 733 bp, Homo sapiens
  misc_feature: GZ8MTXP02I84OW.3.82.H05.1.454.CMB.2.raw
  modified_base (294)..(294): a, c, t, g, unknown or other
  modified_base (328)..(328): a, c, t, g, unknown or other
  modified_base (504)..(504): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagtcgttgggttttccttgttgcttatttacaaaaggtgtccagtgtgaggtgcgaggtggtggagacgtgggaggaggtcttgatccgacggccggtcgggggtccctggacgacttcctcctgtgcacgtcctcgtcgcttccaccgtnagtagcacgtctacagtcgcaccggtgggacccncgacgccgtacggaggggacgggcgtagggaggttcgtacgtacgttagtttaacttactacttacgtacgtacctacgtactacctacccgtacccgtacccggtagaacgggtacctaaacttaaccactcctaccgaagaacggacctaacgttaacggagtaaccgtaggtntaacttactaaacgaaattcgaaaacctaccgtagaacgaaccgtacccggaaacgtaccggtaccggtttaacccgtttaagtttacccgaggtaacccgtacggtaaggtacggtacggtttaacgggtacgggttacccgggggttaccccgtaacgtttaccccgtaaccggttttcggtttaccttacggttactacccgtttcggttacccggggttccgggg

SEQ ID NO: 409553 - DNA, 645 bp, Homo sapiens
  misc_feature: GZ8MTXP02JXOQ0.3.82.H05.1.454.CMB.2.raw
  modified_base (254)..(254): a, c, t, g, unknown or other
  modified_base (574)..(574): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcngcctctggcttcaccgtcagtagcagctacatgcacgtcgggtcccgccaggcctccggaggggaacggggcgtaggggaggtcggggtctacgtagtttactttactaattcgtacggtaccacgtactacctaccgtaccccggacccccggtaggaacgggtacccgaaacttaacccactcctacccgagacgaaccgtacgttacccggaaagtaaaccgtacggtagttacttacttaacaaaagttacgaaaccaccgtagacggaacgaccgaacgacgaccggttcgtttattacgtgtagacgagacgtnttacggaggttcgggtcccgggaacctcgtaacccgttggttacctacttcgacttccgtcgttccggggg

SEQ ID NO: 409554 - DNA, 684 bp, Homo sapiens
  misc_feature: GZ8MTXP02G86P7.3.82.H05.1.454.CMB.2.raw
  modified_base (486)..(486): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttggatccgagccgtgggggtccctgagactctcctgtgcagcctctggcttcaccgtcagtagcagctacatgccacgtcgggtcccgccgacggcctaccggaaggggaacggggtcgtgggtacggttgggtctacgtagtttaacgtttaacaacgtttcgtacggtacccacgtacttaaccctacccgtcccggaaccccgtaggaaccgggacccgtaactaacccatcctaccagacgacacgttaccgaagtaacgtacggtntaacttacttacgaaatacgaaacctaaacgtgaacggtaccgaccgggaactacccgtaacggttacccgttttaagtaccgttggtacggacgtaaggtacggtaacgttcgggtaagggttcggggttacccggggtacctaccgtacccgtttggtaaccttacgttcgacttcgtccgtcgggggtccctcgg

SEQ ID NO: 409555 - DNA, 711 bp, Homo sapiens
  misc_feature: GZ8MTXP02HL6N1.3.82.H05.1.454.CMB.2.raw
  modified_base (436)..(436): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccgagccgtgggggtccctgagactctcctgtgcagcctctggcttcaccgtcagtacgcacgctacatgcacgtcggggtcccgccgacggcctaccggaggggaacggggcgtgggaggttggggtctacgtagttatttacactttcgtacggtaccacgacttacctaccgttcccgaccccgtaggaaccgggtccgtaacttaaacccntacctccgaagacgtaacgtacgttaccgaaggtaaccgtacggggttattaacttaccttacaaaacgttacgaaaacctaaccgtaggaaacgggaccggaaccccggacgtaaccgtaacccggggtttaccgttttaacgtaaccgttggacggtaaccggaaggtcggtaacgtttccgggaaggggtttccgggggttaccggggccccttacgtaacccgtttgggttacccttacgttacgtacttcccggtcggggttcccggggg

SEQ ID NO: 409556 - DNA, 603 bp, Homo sapiens
  misc_feature: GZ8MTXP02HSJ28.3.82.H05.1.454.CMB.2.raw
  modified_base (385)..(385): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcacgcctctggcttccaccgtcagtagcagctacatgcacgtcgggtccgccacggctacccggaggggaacggggcgtgggtaggtgggtctctaagtttatttacaattcgtagtaccactattaccgtacncccgtacccgtggaacgggtaccctattaacccatcctaccgaagacgacgacgttacgacgaacgtacggtgtactcttacaaatacgaactaactagagacgaccgacgaacgacggtaccttaatctagtagacgtagagtacgttcgtacgttcgggttaccggtactccgccgttacgttcgttacgtcgtactcgtcggtcgggtccgtcgg

SEQ ID NO: 409557 - DNA, 737 bp, Homo sapiens
  misc_feature: GZ8MTXP02GUSOP.3.82.H05.1.454.CMB.2.raw
  modified_base (273)..(273): a, c, t, g, unknown or other
  modified_base (297)..(297): a, c, t, g, unknown or other
  modified_base (303)..(303): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagtttggctgagcttgggttttccttgttgcttatttacaaaaggtgtccagtgtggaggtgcgagggtggtggagacgtggagggaggcttgactccgagccggtgggggtccctgacgactctcctgtgcacgcctcgnggcttcaccgtcagtagcagctanatgacncgtcgggtccgcgacggcctaccggaggggaacggggctggggaggtggggtctacgtagttacctttaactaacgttcgtacggtaaccactaacttaccgtaccgtacccggtacccggttacgggaaccgggtacccgtaaacttaaaccgtacttacccgtaccgaaacggaacgtacggtaaccgttaccggaaacgtaaaccgtacggggttataacgttaccttaaactaaaacgtaacgtaaaacccgtaaccgtagggaaacggacggaacccgacgaaacccggtacggttacccgtttaataccggtgtacggacggtagtacgtacgtcgggtaacggttcggggtacccggggtacccttaccgtaacccggttcggtttaccgttaaccgtcgtaacgtttccggtacggttcccggggg

SEQ ID NO: 409558 - DNA, 658 bp, Homo sapiens
  misc_feature: GZ8MTXP02HCIT5.3.82.H05.1.454.CMB.2.raw
  modified_base (581)..(581): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaggtgtccagtgtgaggtgcaggtggtggagacgtgggaggaggcttggactccaggccgtggggggtccctggacgactctcctgtgcacgcctcgtggtcttcaccgtcagtagcagctacagtcgcacgtcgggtcccgaccgacggccgtaccggaggggacggggcgtagggaggtcgggtctacgtagttactttacaagtttcgacggtaccatacttaccgtacctccccggacccggtacggaaacggggtcctaaacttaaccacttcctacccgaagacgaaccgtaacgttacccgaagtaaaccgtagggttactaacttactaacaaaagttacgaaacctaaacgtgaacggacgaaccgaacgaaccgtacggttaccgtttatacgtggtacgngtaagaagtcgtacggtaggtcgggttaccgggacctccgtaccgttggtccttatacgactcgtcgtcgggctcgg

SEQ ID NO: 409559 - DNA, 658 bp, Homo sapiens
  misc_feature: GZ8MTXP02JXHDZ.3.82.H05.1.454.CMB.2.raw
  modified_base (257)..(257): a, c, t, g, unknown or other
  modified_base (297)..(297): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctctgtgcagcctntggtcttcaccgtcagtagcagctacatgcactgggtccnccgaggcctaccgaggggaaggggcctgggaggtgggtctagtaagtttactttacaaatttctaggtacccactataacctactcccggacccgtaggaacggtccgaataaccatcctccgaagagacgactccgaagacacggtgtaatcgttacaaatacgaaacaaacctgaacgagaccccggaacgaaccgaacggtacccggttttaataccgtaggttacgacgtaaggtaggtaacttaccggggtaggttacgggggttaccgggggacccctccgttaacccccggttagggttcccttaaaccgttcccggtaattcccgtcgggtttacgggggccgtttcccgggg

SEQ ID NO: 409560 - DNA, 631 bp, Homo sapiens
  misc_feature: GZ8MTXP02HJLQF.3.82.H05.1.454.CMB.2.raw
  modified_base (470)..(470): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttccgaccgtcagtagcagctacatgcacgtcgggtccgccgacggcctaccggaggggaacggggcgtgggaggtgggtctacgtagtttaattacaacttcgtacggtaccactactacctacctcccggtacccgtaggaaacgggacctaacgttaacccattcccgacgaagacgaccgtacttaccggaagtaacgtacggtntaacgttactaacgaaatacgtaaacaaccgtgaacgacgaccggacgtaacgtacggttactttatacgtggtcgagaaggtactagtcggacggttcgggtccgggaccttcccgtaccgttgtccttacgtcgtacgttcgtcggtcgggtaccgtcg

SEQ ID NO: 409561 - DNA, 599 bp, Homo sapiens
  misc_feature: GZ8MTXP02FLOYP.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctggcttcacccgtcagtagcagctacatcgcacgtgggtccgccgaggcctccgaggggacggggctgggagtgggtctcgagtttatttacaattcgtcgtaccactactaacctaccgtcccggacccgtaggaacggggaccctacttaaaccatccctaccagacgacgacttaccgaagaacgacgtagtactctacaaatcgaaacaacctggacgacgaccgacgaccgacggtaccgttatcgtgtacgacgagacgtgttacggacggttcgggtccggggtacctccgtaccgttggtctacgttcgacttcgtcggtcggggtccgtcgg

SEQ ID NO: 409562 - DNA, 664 bp, Homo sapiens
  misc_feature: GZ8MTXP02HUGVA.3.82.H05.1.454.CMB.2.raw
  modified_base (283)..(283): a, c, t, g, unknown or other
  modified_base (399)..(399): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagacgtgggaggaggcttgatccagccgtgggggtccctgagactctcctgtgcaggcctctggccttcaccggtcagtacgcanctacagtcgcctacggtcgggtccgacgacggccgtaccgggaaggggaacggggtcgtagggacggttcgggtctagtagttacttataacgttctacgtacatactaccctacncccgtaccgtaggacggacctaactaaccgattccacgaagtacgacgtacgtaccggaagtaaacgtcggttataactcttaacaaagtacgaaccacgtagaagaccgaccgtaacacgtaaccggttctttagacgtgacgagtaacgagtacgttagggacggttaccgggttaccgggaaccttccgtacccgggtttaggtttaacccttaacggttacgtacgttaccgttcccggggaggggtttccccgtaaccgg

SEQ ID NO: 409563 - DNA, 657 bp, Homo sapiens
  misc_feature: GZ8MTXP02I5R6S.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtgggaggaggcttgatccgagccgtgggggtccctgagactctcctgtgcagcctctggccttccaccgtcagtagcagctacatgcacgtcgggtcccgccgaggcctaccggaaggggaacggggcgtagggaggttcggggtctagtaagtttaactttaacaactttcgtacggtacccaacgtacttacctacccgtacccggacccccggttaggaaaccggggtacccgtaaacgttaaacccagtacccgtaccgaaggacgtaacgtaaccgttaccggaacgtaaacgtacgggttatactcttaaacaaagtacgaaactaaccgtagacggacgaccgacgacgtacggtactttatacgtgcgtagagagtacgtcgaggttcgggtaccggcctacgtaaccgtggttacctacgtcgtactcgtacggtccgggg

SEQ ID NO: 409564 - DNA, 726 bp, Homo sapiens
  misc_feature: GZ8MTXP02IOY07.3.82.H05.1.454.CMB.2.raw
tcagagacgcactccacgaccggtgctcgatttagtcgagctctctcgcgggggctggggagaggagcccagcactgggattccgaggtgtttccattcggtgatcagcactgaacacagaggactcaccatggagttttggctgagctgggttttccttgttgctatttcaaaagtgtccagtgtgaggtgcgaggtggtggagacgtggaggaggcttgatccagccgtgggggtccctgagactctcctgtgcagcctctggcttcaccgtcagtacgcagctacagtcgcacgtcgggtccgccgacggcctccggaaggggaacggggtcgtagggtacggttggggtccgtacgtaacgtttaactttaacctaagtttaccgtacggttaaccaaccttacttacccgtacccgttacccccggaccccgggttacggaaccggggtacccgtaaactttaaacccacgttcacccgaagacggaactacgttacccgaacggtaaacgtccgggttataacttcgtaaactaaactaaacggtaaaccctaaccgtagggaacgaaccggacccggtaaacgtaaccgtaaccggggttaccttttaagttaccgtagttacggacgaggtaacgtacgtttacggaacggtttcgggtaaccgggtacccttcgtaacccgttaggttccttacgtacgacttccggtcgtacgggg

SEQ ID NO: 409565 - DNA, 676 bp, Homo sapiens
  misc_feature: GZ8MTXP02JZV4W.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggctcaccgtcagtagcagctacatgcacgtcgggtcccgccgaggcctaccggaaggggaaggggcgtggggaggttggggtcctacgtaagtttaactttacgtaacgtttcgttacgggtacccaactaacttaccgtaacctccccggtaacccccggtaggaaacggggtacccgtaaacttaaacccacgttccctacccgaaggtaacgaacccggtattacccggaaacgaaccgttacggttagttacttaccgtttaacaaaatcggtaaaaccacgtgaagaccgacccgaacacggtaccggtacttttaatacgtgtacggacgtagaagtcgttacgaggttcgggttaccgggacctcgtaacccgttggttacctacgttcgactttccggtcgtcgggg

SEQ ID NO: 409566 - DNA, 740 bp, Homo sapiens
  misc_feature: GZ8MTXP02J0PCW.3.82.H05.1.454.CMB.2.raw
  modified_base (264)..(264): a, c, t, g, unknown or other
  modified_base (284)..(284): a, c, t, g, unknown or other
  modified_base (289)..(289): a, c, t, g, unknown or other
  modified_base (296)..(296): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgcttatttacaaaaggtgtaccagtgtgaggtgcgaggtggtggagacgtgggaggaggtcttgatccgagccggtgggggtccctgagactctcctgtgcngcctcgtggtcttcaccgtnagacncagctanatgccacgtcgggtcccaccgaggcctaccggaaggggagggcgtgggaggtggtctacgtaatttaccttaacgtactttcgtacggtaaccacttaacttaccgtacccgtaccccggtaacccgtagggaaccgggtacctaaaccttaaacccacttacccgaaccgacggtaacgtaaaccggtacgttacccggaaacgtaacgtacggttacgtacttaccttaaacgaaactaacgtaaaccaaccggttagacgggaaccgaccgtaaaccggaaccgtccggttaccgtttaattcggtacggtacgtacggaaaggtacgtaggtttaccgggcgggtttacggggtacccggggtaacccttaccggtaaccgtttaccggggtttaccttaccggttacggtacgtttcccggggtacggttacccggggg

SEQ ID NO: 409567 - DNA, 805 bp, Homo sapiens
  misc_feature: GZ8MTXP02I5D9R.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccgaggccgtgggggtccctgacgtactctcctgtgcagcctctggtcttcaccgtcagtagcagctacatgccacgtcgggtccgccgacggcctccggaaggggacggggcgtaggggtaggtcgggttacctacgtaggtttaactttaaccgaactttccgtacggtaccctaactacttaacccgtacccgtcccccggtaacccccggtagggaaaccggggaccccttaaacgttaaaccctaacttacccgtacccgaaaggacccggtaacgtaacggttacccggaaacgtaaacccgtacggggttaacttaacgttaccttaaaaccgaaagttaacggaaaaccctaacggttacggaaacgggtaaccggcccggaaacccggtaaccgtaaccgggttaccgtttttaaacgtaccggttacgggtacgggaccggtaaagtaccggtagtttaaccggggtggggtttaaccggggttccggggtaaacccttccgtacccccggtttagggttaactttacccggttacgaccttccgggtttccggcgggggttacccgttccgggg

SEQ ID NO: 409568 - DNA, 842 bp, Homo sapiens
  misc_feature: GZ8MTXP02HMNNA.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagagactcaccatggagttttggctgagcttgggttttccttgttgctatttacaaaaggtgtccagtgtgaggtgcaggtggtggagacgtggaggaggcttgatccgagccggtgggggtccctgacgactctcctgtgcacgcctcgtggcttcaccgtcagtacgcagctacatcgaccgtacggtcgggtcccgccgacggtccgtacccggaagggggaacggggtcgtaggggtagggttcgggttactacggttaagttttaacgtttaactaacgtttaccgttacgggtaacccttaactacgttaacccttaacccgtacccccgggtaacccccgggttaagggaaacccggggtacccgttaaacctttaaacccgaactttcccgtaaccgaacgaacggtaaaccgtacgttaccggaaagtaaaccgtccggtaattacttactaactaaaacgtacgtaaaaccaaacgtaggaaacgacgacccggaacgtaaccccgttaaccgggttaccgttttaaacgttacggttacggttacgggaccgtaaagtacggttaacggtttacggggtacggggtttaccggggtttacccgggggttcccctaacccgggttaaccccgtttaccgggtttaaccgtttacccggtttaaccgtttccggtacccggttttccggggtccgggggtacccccggtttacccgggg

SEQ ID NO: 409569 - DNA, 618 bp, Homo sapiens
  misc_feature: GZ8MTXP02JHEUO.3.82.H05.1.454.CMB.2.raw
  modified_base (452)..(452): a, c, t, g, unknown or other
  modified_base (478)..(478): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtcccgccgaggcctaccggaggggaaggggcgtgggaggtgggtctcgtagtttacttacattctacggtaccactactacctaccgtacccgacccgtagacgggaccgtaactaaccatcctacgagagacgtattaccgaagaacgtacggtntactcttacaaaatcgaacctaacgngaacgacgaccgaacgacgtacggtaccgtttaattacgtgtacgacggtagtatacgttacggagggttcggggttaccggggacccttacgaaccccgtttggttacccttacgttaccgacttcggtcggtcggggg

SEQ ID NO: 409570 - DNA, 677 bp, Homo sapiens
  misc_feature: GZ8MTXP02H8DZD.3.82.H05.1.454.CMB.2.raw
  modified_base (237)..(237): a, c, t, g, unknown or other
  modified_base (276)..(276): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatccctcgtgtctgcatcgtggtaggggacagagtcgctatgacttggcgggcactcgtacggtttaacngtattggtatctggtatcagcaagaaaccgagggaaacnccccgtagtacgttcctgacgtgtctgcctagctacgtcccacctgacctaaaggtcgaccgtacccagtccagtactcgagtccgtataggtctagtcgtacggggaactagtacgtacacttcctacctacactacgacgacgtaccggtctacggacctaacgtacccgttaggtaaagtttacctttacggtaaaccttaaaccgtttttactaaacgtttacgaaaccgtaaaaccggtcgtacgttacggaaccttaccggttccccttccccgtaacttcgttaccgggtttacgggaccggggttaaacggaacccgtaggggtacggtaactaaacgttaaccggaaaacgttaaacgttcggtaacgggtacctcggaacccctttaacgg

SEQ ID NO: 409571 - DNA, 693 bp, Homo sapiens
  misc_feature: GZ8MTXP02FVU9L.3.82.H05.1.454.CMB.2.raw
  modified_base (280)..(280): a, c, t, g, unknown or other
  modified_base (309)..(309): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgcttatttacaaaaggtgtccagtgtggaggtgcgagggtggtggagacgtggaggaggcttgatccgagccggtcgggggtcctgagctctctgtcgcagcctgtcggcttcacgtnagtacgcagctacatgcacgtcggtcccncgacggccgtaccgggaaggggacgggtcgtggggtagtcgggtactagtagtttaacttaactagttacgtacgtaaccaactaacttacctacccgtaccccggtaacccggtacgaaaccggggtaccctaaactttaaacccagtttaccccgaacgaacgtaaacgaccgttaacgttacccgaaggtaaactacggttataaacgttaccttaaaacgaaaattaaccgaaacctaaccgtaggaaacgaccgacccgagtaaccgtaccggttacgtttataccgtggtagacgtaaggtagtacggttcgtagggttccgggtaaccggcctacggtaaccgttgttactacgtcgtacctcggttcggtccgggg

SEQ ID NO: 409572 - DNA, 662 bp, Homo sapiens
  misc_feature: GZ8MTXP02HROTT.3.82.H05.1.454.CMB.2.raw
  modified_base (261)..(261): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccgagccgtgggggtccctgagactctcctgtgcacgcctntcggcttcaccgtcgagtgcagctacatgcacgtcgggtccgccgacggccgtaccggaaggggaacggggccgtgggtaggtcgggttactagtagtttaattactacttcgtacgtaccactatacctacgtcccgaccgtaggaaccggcctaacgttaaccattccaccgaagacgacgtacgttaccgaagtaacctagggttatacgttacttaaacaaagttaccgaaaacctaacgtgaaagaccgcccggaaacgtacgaccggttactttaaatcgagtcgacgaagtgtagtttcggaacggtttcggggtacccggtaccctaccgttacccgttacggtttcctaacgtttcgacgttcccgtcggggtaccgggtcccggttaccgg

SEQ ID NO: 409573 - DNA, 636 bp, Homo sapiens
  misc_feature: GZ8MTXP02H0RFB.3.82.H05.1.454.CMB.2.raw
  modified_base (303)..(303): a, c, t, g, unknown or other
  modified_base (425)..(425): a, c, t, g, unknown or other
  modified_base (543)..(543): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctcgtggcttccaccgtcagtagcagctacatgcacgtcgggtcccnccgaaggcctacggaaggggaaggggcgtagggagtggggtctacgagtttaacttaacaatttcgtaggtaaccacgactacctaccgtcccgaccccgtagaacggaccgattaaacccntacccacaagacgaacgacttaccggaacgaaacacgggtacttatactaacaaaatcgaaactaaccgtagacgaacgccgtaaacggtaccacgggttacccttttaagttaccgnggtagcggaagcgtaaagtttcggagttcggggtacccggtacctaccgtaacccgttcggtaccttacgttacgcttaccgtcgtccggggg

SEQ ID NO: 409574 - DNA, 717 bp, Homo sapiens
  misc_feature: GZ8MTXP02FN34Z.3.82.H05.1.454.CMB.2.raw
  modified_base (546)..(546): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtgggaggaggcttgatccagccgtggggggtccctgagactctcctgtgcacgtcctctggcttcaccgtcagtagcagctacatgctacgtcgggtccgccgacggccgtccggagggggaacggggccgtaggggagggttcgggttctacgtaggtttaacctttaacgtaacgtttcgtacggtaccaactacttaccgtaaccgtccccggtaacccggtaggaaacgggtacccgtaaactttaaacccgacttacccaccgaaaggtacgaaaccggtactttaacccggaacggtaaaacccgtacggggtttaactaacttacccttaaanaaacgttagaaaacccaaccgttgggaaacgaacggaccccgtaacgtaaaccgtccgggttaaaccgtttaataaacgtgtcgaacgagtacgtaagttcgagggttccgggtacgggtaccccaccgtaaccgttcggttactccttacgtcttccgacggttccgggg

SEQ ID NO: 409575 - DNA, 592 bp, Homo sapiens
  misc_feature: GZ8MTXP02FZ7L6.3.82.H05.1.454.CMB.2.raw
  modified_base (287)..(288): a, c, t, g, unknown or other
  modified_base (291)..(291): a, c, t, g, unknown or other
  modified_base (299)..(299): a, c, t, g, unknown or other
  modified_base (396)..(396): a, c, t, g, unknown or other
  modified_base (508)..(508): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggagggaggcttgatccagccgtgggggtccctgagactctcctgtgcacgccgctggcttcaccgtcagtgcagctacnngcncgtggccnccgaggctcggagggagggcgtgggagtggtctactagtttacttactatcgtagtaccactactctacctccgacccgtagacggacgactaaccntctaccagacacgtataccgagaacgtacggtatagtcttaacaaagtacgaaaccaccgtgaacgacgacccgacgacgtaccggtactttaagtacgtggtacgcggaanaggtacgttcgggaacggttcgggggttaccggacccttccggtaaccgttcggttctacgtccgtattccgtcgggtccgggg

SEQ ID NO: 409576 - DNA, 735 bp, Homo sapiens
  misc_feature: GZ8MTXP02HBT6T.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagcttgggttttccttgttgcttatttacaaaaggtgtccagtgtgaggtgcaggtggtggagacgtggaggaggcttgatccgagccggtgggggtcctgacgactctcctgtgcgacgtcctcgtcgtccttccgaccgtcgaagtacgcacgactacagtcgcgtacgtcggtccgcgacggccgtacggaggggaagggcgtagggtacggttggtactacgttaagtttaactttaacgtaacgtttcgtacgtaacctaacgtaactaacccttacccgtcccccggtacccggtacggaaaccgggtacccgtaaaccttaaaccacttcccgaaaccaaggtaaccgaacgtaaccgtaccggaaaacgtaaaccggttcggtattaaactacccgttaaagaaaactaacgaaaccctaaaccgtggaaacgaccgacccggaaacgtacccgtaaccgggtttacctttaatacgtgtaccgaagtacgtaaagttcgttacggaacggttcgggggtacccgacctacccgtaacggtttcgttaacctacgttcgtacgttccgtcgggtccggggctaccgg

SEQ ID NO: 409577 - DNA, 657 bp, Homo sapiens
  misc_feature: GZ8MTXP02GL352.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtggggggtccctgagactctcctgtgcagcctcgtggcttcaccgtcagtgcagctacatcgcacgtgggtcccgccgaggcctaccggaaggggaacggggctgggaggtggggtctacgtagttaatttacaactttcgtaggtaaccactactaaccttactccccgaccccgtaggaaacggggtaccctaattaacccatcctaccagaacgtacgacttaccgaagaaaccgtcgggtataactcttaacaaaattacgaaaccaaccgtgaacgacgacccggaacgaaccgtacggttacttttactaacgtggtacgacgtaagtacgtacgttacggaaggttcggggttaaccgggaccttacgtacccccgttggttaaccctacgttacgacttcgtccggtcgggggcccgttacgg

SEQ ID NO: 409578 - DNA, 640 bp, Homo sapiens
  misc_feature: GZ8MTXP02F7RW7.3.82.H05.1.454.CMB.2.raw
  modified_base (276)..(276): a, c, t, g, unknown or other
  modified_base (280)..(280): a, c, t, g, unknown or other
  modified_base (282)..(282): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgcttatttcaaaaggtgtccagtgtgaggtgcagggtggtggagacgtggaggagcttgatccgagccgtgggggtccctgagactctcctgtgcacgcctcgtggcttcaccgtnagtncngctacatcgcacgtggtccgccgaggccgtaccggaggggtaggggtggaggtggtctcgtagttattactatttcggaccatactacctacgtcccgacccgtggaacggccgtaataccgatcgacagagacgtacttacgaagtaacgtcggtatacttacttaacgaaatacgaaacctaaccgtaggacgaacggacccgaaacgtaccggtaaccgggttacctttaaacgttcgtaggttacggacgaagtacgtagttcgggacgggttacggttccggggtaccctccgtaccgttcggttccttaacgtcggtacttcgacggtcggggtactcggacccttacccgg

SEQ ID NO: 409579 - DNA, 802 bp, Homo sapiens
  misc_feature: GZ8MTXP02GO2EG.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtcgggtccgccaggcctccgaagggggaacggggcgtggggaggtgggttctacgtagttatttacgaatttcgtcggtaaccactacttacctaccgtcccggaaccccgttaggaaacggggtacccgtaacttaaaccacgttaccctacccgaagaacgtaaccgtaacgtttacccggaaagtaaaccgtacgggttagttaacttacctttaaaccgaaaaagttaccggaaaacccctaaacccgttaggggaaacggtaaaccggtaccccgggaaaacccgtaaacccggttaaacccggggtttaccccggttttttaaagttaaacccgttgggttaacccgggaccggtaaaggtaaaacgttcgtttacccgggggaaagggttttccgggggttcccggggtaaaccccttccgttaacccccgggtttgggtttaacctttaaaccggttcgttaaccgttcccggttccgggttacggggggtccccgtttccgggg

SEQ ID NO: 409580 - DNA, 748 bp, Homo sapiens
  misc_feature: GZ8MTXP02II4PO.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtcctgagactctcctgtgcagcctctggcttcaccgtcagtagcagctacatgcacgtcgggtcccgccgaggccgtaccgaggggaacggggcgtaggggaggttcgggtctacgtagtttaactttactaacgtttccgtacggtaacccactaactaaccttaacccgtccccggaaccccggttaggaaaccggggtcccgtaaactttaaacccgacttacccgtaacaaaggaccgaaccgtacgttaccccggaaagtaaaccgtacgggttactaacttaccgttaaacgaaaattccggaaaacctaaacccgttagggaaacgtaccggacccggaaaccggaccgtaaccgggttcccgtttttaaagtaccgttaggtacgaccggtaaggtaacggtaacgttttccggggaacggtttccgggggttaccgggtaaccctccgtaacccgttggttaacccttacgtacgtacgtccgttcggtaccgggggttcctacggg

SEQ ID NO: 409581 - DNA, 837 bp, Homo sapiens
  misc_feature: GZ8MTXP02IXUPP.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgcaggtggtggagacgtggaggaggcttgatccgagccgtgggggtccctgacgtactctcctgtgcagcctcgtggtccttcaccgtcagtacgcagctacatcgacctacggtcggggtcccgaccgacgggtccgtacccggaaggggggtaacgggggtccgttagggggtacgggttcgggggttacctttacggttaaaggtttttaaacttttaaccgtaaaacgtttttccgttaacgggtaaaccctaacctaaaccgttaacccttacccccgttaccccggggtaaccccccgtaggggtaaaaccgggggtcccttaaaaccgtttaaaccccgacttacccgtaaccccgaaaggtaaccggtaaacccgtaccgtttacccgggaaaacggtaaacccgttacggggttacttaaacgttaccttaaaacgtaaaaacgttaccggaaaacctaaaaccgtggaaacgtaccggacccggtaaaccgaacccgtacgggttacccgtttaagttaccgtggtacgacgtaaggtacgtaacgttcgggtaagggttcggggttacccgggacttaccgtaacccctttggttaaccttacgttacgcttccgtccggtcggggtacccgtcgg

SEQ ID NO: 409582 - DNA, 757 bp, Homo sapiens
  misc_feature: GZ8MTXP02F45TZ.3.82.H05.1.454.CMB.2.raw
  modified_base (276)..(276): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccagccgtgggggtccctgagactctcctgtgcagcctctggcttcaccgtcagtancagctacatgcacgtcgggtccgccaggcctccggaagggggaaggggcgtgggaggtggggtctacgtaagtttatttaacaactttcgtacgtaccactactacctactccccgaccccgtaggaaacgggtccgaacttaaaccactcctacccgaagtacgaaccgtaacgtttacccgaaagtaaacccgtacgggttagttaacttaccgtttaaaacaaaacgttacgaaaacccgaaaacccggttaggaaccggaaacggaccccggaaaccggtaaaccccgtaaccgggtttaccccgtttttaaagttacggtttacgtaggaacgggtaacggtaacgttacggtttacggtacggggtttacgggggtttaacccgggggtaccctttacccggaaccccgttttcggttaacccgtttacgttaccggttacttcccggtttcggtccgggggtaccgtttcccgg

SEQ ID NO: 409583 - DNA, 691 bp, Homo sapiens
  misc_feature: GZ8MTXP02GGEJ8.3.82.H05.1.454.CMB.2.raw
  modified_base (291)..(291): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtggaggaggcttgatccgaggccgtgggggtccctgagactctcctgtgcagcctcgtggcttccgaccgtcaagtagcagctaanatgaccacgtcgggtccgccgaggctacccggaaggggaacggggtctaggggaggtgggtcctacgtaagtttaactttaaccaatttcgtacggtaacctaactataacctaccgtccccgggtacccccgtaggaaacggggtaccctaacttaaaccattccaccgaagtacgaaccgtaacttcgaaacgtaaaccgagggttactaattaccgttaaacaaaacgttaacggaaaacccaacgtaaggaagacggacccgtaaacgaacccggacgtaaccgtttaatacgtggacgacgaagaagtaccgttggaacggttggggtacccgggtacctacctacccgttggtaaccttaacgtcgtactccgttcggcggggtccgtacccgg

SEQ ID NO: 409584 - DNA, 742 bp, Homo sapiens
  misc_feature: GZ8MTXP02HIUGA.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgcagggtggtggagacgtggaggaggcttgatccaggccgtgggggtccctgagactctcctgtgcagccctctggcttcaccgtcagtagcagctacatcgctacgtcgggtccgaccgaggccgtaccggaaggggaacggggcgtaggggaggttcggggtccttacgtaagtttaactttaacgaaccgtttcgtacggtaaccctaacgtacgttacctacccgtcccccggaacccccggttaagggaaaccgggtaccgtaaaccttaacccgactccctaccgaagaacgaaccgtacgttacccggaaagtaacgtacgggttacgtaactttaccgtaaacgtaaaacgtaacggtaaaacccaaaccgttggaaacggaaccggtaccccggaaaccgtaccgtaaccgggttaccttttaaggttactcggtacggacgtaagtagtacgttcggtacgggtacggggttcccgggacccttaccgtccgttacggttccttaacgttccgacgttccgtccggtccgggggtcgtccgg

SEQ ID NO: 409585 - DNA, 675 bp, Homo sapiens
  misc_feature: GZ8MTXP02G5ZIA.3.82.H05.1.454.CMB.2.raw
  modified_base (257)..(257): a, c, t, g, unknown or other
  modified_base (645)..(645): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttacaaaaggtgtccagtgtgaggtgcaggtggtggagacgtgggaggaggcttgactccgagccgtgggggtccctgagactctcctgtgcngcctcgtggcttcgaccgtcagtcgcagactacatgctacgtcgggtccgccgacggcctaccggaagggggaacggggcgtggggtaggttcggggttctacgtaggtttactttacgtaacgttcgtacgtacctactactaacctaccgtcccgtacccgtaggaaccgggacctaacgttaaccactcctacgagaacgacgtacttaccggaaagtaacgcggttagtaactacgtaacaaagtacgaacgtaaccgtgaacgaccgtaccggaacaccgtacggttactttatacgtgtagacgaagtacggtacttcgggagggtttccggggtacccgggaacccttccgtaaccgtttgggttaaccttacgttaccgngttcccggttcggtcgggggtcccttacgg

SEQ ID NO: 409586 - DNA, 667 bp, Homo sapiens
  misc_feature: GZ8MTXP02HNUZW.3.82.H05.1.454.CMB.2.raw
  modified_base (577)..(577): a, c, t, g, unknown or other
  modified_base (593)..(593): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggtagttttggctgagtcgttgggtttttccttgttgtcttatttacaaaaggtgtccagtgtgaggtgcgaggtggtggagacgtgggagggaggtcttgactccgaggccggtcgggggtccctggacgtactctccgtgtcgcacgcctcgtcggtccttccgaccgtcagtacgcagctacatcgccacgtcggtcccgccgacggccgtaccggaggggacgggcgtgggaggtcggtctacgtagtttacttaacgtacgttcgtacgtacctactaacttacctacccgtaccccggtacccggtaggaaaccggtaccgtaaacttaaccgacttccgaccgaagacgtaacgtacgttaccgaacgtaacgtcggtatactactaaacaaatacgaaactacgagacggacgacccgaagacccgtacggttctttanacgtgacgacgtaagngtacgttcggaggttccgggtaccgccttaccgtaacccgtttgtaccttacgtcgtacgtcgtcggtccgggg

SEQ ID NO: 409587 - DNA, 564 bp, Homo sapiens
  misc_feature: GZ8MTXP02GA4KM.3.82.H05.1.454.CMB.2.raw
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcaagaaaccagggaaacgcccctagacgttcctgatgtctgctgcatccaccctgcaaagtgagtccatccagattcagcgtcagtgatctggggacagattcactctacaccatcagcagcctgcgagcctagaagtattttcgactaaacttactattgtaccaactaggctagactacgtcctaccccgctaccgacgttttccgggaccggggtaaggggaacccgtaaaggggttagggaacgtaacgtaaacccgtaaaaaccgtaaacgttacgggtacggtaccgtacggacctaaacccg

SEQ ID NO: 409588 - DNA, 646 bp, Homo sapiens
  misc_feature: GZ8MTXP02IRPXO.3.82.H05.1.454.CMB.2.raw
  modified_base (280)..(280): a, c, t, g, unknown or other
  modified_base (285)..(285): a, c, t, g, unknown or other
  modified_base (503)..(503): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggtagttttggctgagcgtggtttctgtgctattacaaaggtgtcagtgtgaggtgcaggtggtggagagtggaggaggcttgatccaggccggtgggggtcctgagactctcctgtgcacgtcctcgtggtcttccaccgtcagtagcgancctanatcgccacgtcgggcccgcgcggtccaccggaaggggacgggcgtgggaggtcggtctacgtagtttacttaactactttcgacgttaccaacttactaaccgttacctccccggtacccggtaggaaccgggtacccgtaactttaaaccgctaccgtaccgaacgaacggtacgtacgttaccggaaagtaaaccgtcggttatactaccttaaanaaactaacgaacacgtagacgacgaccgacgacgtacgttacttagtcgtcgtagacgagtacgtggttacggtacggttccggtacgtaccgtaccgtccgttacgttccgttacgtcgtacgtcggtcggtacggtcgtcg

SEQ ID NO: 409589 - DNA, 830 bp, Homo sapiens
  misc_feature: GZ8MTXP02FHNYO.3.82.H05.1.454.CMB.2.raw
  modified_base (267)..(267): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagtttggctgagcgttgggttttccttgttgctatttacaaaaggtgtccagtgtgaggtgcgagggtggtggagacgtgggagggaggcttgactccaggccggtggggggtccctgacgactctcctgtcgcncgcctctggtccttcaccgtcgagtagcacgctacatcgacctacgtcggggtaccccgcgacggccgtaccggaagggggaacggggtcgtagggggtacgggttcgggtccttacgttaagtttaaccgtttaacgtaacgtttcgtaccggttaaaccctaacgttaacttacccgtaaccccggtacccccggtaaccccgggttaaggggaaaccggggtaaccctaaaaccgttaaaccctaaaccgttacccgtaacccggaaaggtaaccggtaaacccggtaaccgtttaacccgggaaaacggtaaaacccgttaacggggttacgttaaacgttaaccttaaaccaaaacggttaccgaaaacccgtaaaccgtacgggaacggaaccggaaccccgaaacggtacccgtaaccggggttacctttaacgtacgttagacggtaacgaaggtacggttaacgttaccgggtaggttacccggggttccgggtacccttaccgtaaccggtttcggttacctacggttacgtacgtccgtcgggttcccgggg

SEQ ID NO: 409590 - DNA, 756 bp, Homo sapiens
  misc_feature: GZ8MTXP02IWUJI.3.82.H05.1.454.CMB.2.raw
  modified_base (256)..(256): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttacaaaggtgtccagtgtgaggtgcaggtggtggagacgtgggaggaggcttgatccaggccggtgggggtccctgacgactcgcctgcnctaccttcgtggtacttccaccttcacgtctacaagtcggacctacgtacggtggaccgtcgggtcccgccgacggccgtaccggaaggggaacggggtcgtggggtagggtttcggggtttcggtcccggtttacgtaaggaacggtaaccaaacccgtaaactaaacgagtaccgaacgacccgacaacgtaaacgtacccggcccgtccgttaccgtaggtaacggaaacgggacctagttaaccttcccaaacccgtattaccctaacgaaggtaacgtagttcgaacgttacgaaacggtaacgttaaaccttacctttaaagtttacctaccgttaaacgaaacttaaagtacgtaaacgacggtaccgtaaggaaaccgaaaccccggacggaccgacccggtaccttacttaacgtttacgttcgtacgttactaaaacgtcggaaaccgttaaacggacgtaaacccggaacggttacggtttaacccggg

SEQ ID NO: 409591 - DNA, 588 bp, Homo sapiens
  misc_feature: GZ8MTXP02GBG66.3.82.H05.1.454.CMB.2.raw
  modified_base (499)..(499): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtggtccgccaggctccgaggggaaggggctgggagtgggtctcgtagtttatttacaatttcgtggtaaccacactacctactcccggaccccgtaggaacgggccgtaattaaccatcctaccgagacgacgtattacccgaagaacacggtgtaactctacaaatacgaaacaacctgagacgaccgaacgacgacggtacttatacngtacgagagacgtagtaccgaggttcggttacggggacctaccgtacccgttggttaacctcgtcgacttccgtacggtcggggctcgg

SEQ ID NO: 409592 - DNA, 636 bp, Homo sapiens
  misc_feature: GZ8MTXP02G5EXC.3.82.H05.1.454.CMB.2.raw
  modified_base (253)..(253): a, c, t, g, unknown or other
  modified_base (275)..(275): a, c, t, g, unknown or other
  modified_base (277)..(277): a, c, t, g, unknown or other
  modified_base (283)..(283): a, c, t, g, unknown or other
  modified_base (301)..(301): a, c, t, g, unknown or other
  modified_base (434)..(434): a, c, t, g, unknown or other
  modified_base (477)..(477): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcgtgggttttccttgtgctattcaaaaggtgtccagtgtgaggtgcaggtggtggagacgtgggaggaggcttgatccaggccgtgggggtccctgacgctctctgtncagcctcgtgctcacgtcagtncngctacntacgcaacgtcggtcccncgaggtcctaccggaaggggacgggcgtggtaacggtggtcctacgttaagtttaccttaacgattcgtacgaccactaactaccgttaccgcccgtaaccccggtagaaccgggtaccctaatttaaacccncgttccaaccgagaacgtacaagttccgaaagtacaccggttntatactaagaactacgaacgacgagacgacgaccgacgaccggttacgtacttatcgtacgtagacgtagacggtacgtacggtcggttccggtaccgtacccttaccggtaaccgttggttaacccttcgttaccgtcgtttccggtaccgggtcggg

SEQ ID NO: 409593 - DNA, 762 bp, Homo sapiens
  misc_feature: GZ8MTXP02IU3GP.3.82.H05.1.454.CMB.2.raw
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatcgacccagtctccatcctccgtgtctgcatcgtggtaggggacagagtcgctagtgtacttggtcgggcgtacgtcggtacgtttaacagtattggttagtcgtagtatcagacaagaaaccgaaggaacgccccgtagacgttcctgattcgtacgtcgtcgtgacctacgtacccaccgtagacgtaaaacggtcggaacgtccccataccccgaagtagttaaccggacgtacgtaacgtcggtaacgttacggtacgggtaaccgtacgtacggtttacctaccttacccttaccgtaacccgtacttaccgacggttacccgacggtaacccttcggaccgtaaccgtaccgtaacggttaaacgttaaacgttttacgttaaccggttaaaccttttaacctttaacggttaaacgtaccgtaaaccggtaacggttcccggtaaagtacccggttaccgtacccgtaccccggttcgttaccggttacccggttcggggtaaccggggacgggtaaaccgggtaacggttacgggaacgtaaacgtaacggtaaaacccggtaaacgtcgggttacggtaaccgtacgtaaccccg

SEQ ID NO: 409594 - DNA, 681 bp, Homo sapiens
  misc_feature: GZ8MTXP02HFNKK.3.82.H05.1.454.CMB.2.raw
  modified_base (264)..(264): a, c, t, g, unknown or other
  modified_base (282)..(282): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgcgaggtggtggagacgtgggaggaggcttgatccgaggtccggtcgggggtccctgacgactctccgtgtgcngcctcgtgcttcaccgtnagtgacagactacagtacgccgtacggtcgggtcccacgacggtccgtacccggaaggggtaacggggccgtaggggtacggttggggttacctaccgttaaggtttaactttaacgaaccgtttcgtacggtaacccacgtacttacctacccgtcccggacccgtaggaaacgggcctaacttaaccactccaccgagaacgtacgacgttaccgaagtaccgtacggtagttaacttcgtaaacaacgtacgaaacctaacgtagaagaccgaccgaaaccggtaccgtaacggtttcccgtttaaagtcgtagtcgagtaagacgtacgtcggtaggtcggttccgggacctccgtcgttcgttcgtagtccgtactcgtcggtcggtacgtccg

SEQ ID NO: 409595 - DNA, 886 bp, Homo sapiens
  misc_feature: GZ8MTXP02JXW2F.3.82.H05.1.454.CMB.2.raw
  modified_base (263)..(263): a, c, t, g, unknown or other
  modified_base (303)..(303): a, c, t, g, unknown or other
  modified_base (315)..(315): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggtagttttggctgagcttgggttttccttgttgctatttcaaaaggtgtccagtgtgaggtgcgaggtggtggagacgtggaggaggtcttgactccaggccggtcggggggtccctgagacctctcctgtgcngcctcgtggtctccaccgtcagtagcacgctacatcgacncgtcgggtcccnccgacggcgtccggaaggggacggggtgtggggtaggtcgggttctacgtaagtttactttaactacgtttaccgtcggtaaccctaacgtacttaacccgtaccgtacccccggtacccccgttagggaaaccggggtcctaaaccttaacccacttcccgaacccgaacgtaacggtaaccgtaacggttacccgaaggtaaaaccctaagggggtttacctttaacgtaaccgtttaacgaaaacggttaaacgaaaccccgttaaaccggtacggtaaaccggacccgggaaaccccggtaccggtaaaccccggttaaacccgggttaccccgttttttaaacgggtacccttaggggttcgaaacccgggttaagggttaaaggtacggtttttaaccgggggaaacgggggttttcccgggggttcccgggggtaaaaccccctttccccgggttaacccccggttttacggggttttaaccccgttaaaacgggttttcccccggtaaagtttcccccggtttttacgggggacccgggggtttacccgggttacccccgggg

SEQ ID NO: 409596 - DNA, 610 bp, Homo sapiens
  misc_feature: GZ8MTXP02H9870.3.82.H05.1.454.CMB.2.raw
  modified_base (285)..(285): a, c, t, g, unknown or other
  modified_base (300)..(300): a, c, t, g, unknown or other
  modified_base (401)..(401): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatcgacccagtctccatcctccgtgtctgcatctggtagggacagagtcgctatgacttggcgggctacgtcggtacggttttaacagtagttggttagtcgtaggtatcgagacaagaaaccgaggaaacnccccgtgacgttccngatgtctcgccgcactcccacctgacaaaggtcgactcccatccgatacctcagcgtacgagtagagtcgtagggaacagtacgttcactctacaacctanacacgacacgcctagactacgtacgtagtagttacttacgaaacctttaactttaacgttagtacgtaacgaacgtagtactacgacgtacgttcccgtacccgtacgttaccgttacggttacggggacggaacggtaaccggtaagggtacgaaacgtaacgtaacgaaaacggtacgtacggtacggtactaccgacctacgtacg

SEQ ID NO: 409597 - DNA, 669 bp, Homo sapiens
  misc_feature: GZ8MTXP02FNDUR.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggtagttttggctgagcttgggttttccttgttgctatttacaaaaggtgtccagtgtgaggtgcgaggtggtggagacgtgggaggaggcttgactccagccggtcgggggtccctgacgactctcctgtgcacgcctctggcttcaccgtcagtagcagctacatgcacgtcgggccgccgaggcctaccggaggggaacggggctgggaggtgggtctcgtagtttattacacttcgtacgtaccactactacctacctcccggacccgtaggaacgggcctaacttaaccacttcctaccgaaggacgtacgtacgttaccgagtaaaccgtcgggttataacttcttaaacaaattacgaaacctaacgtgaacgacgtacccgaacgtacctaccgggttcgtttaacttacggtgtacgtacgaacggtagtagtttacgggtacggttcgggggttacccgggtaccctaccgtaccgtttcggtaacgtttaccgtcgtacgttcccgtcgggtccgggggtccttaccggg

SEQ ID NO: 409598 - DNA, 622 bp, Homo sapiens
  misc_feature: GZ8MTXP02JIPSU.3.82.H05.1.454.CMB.2.raw
  modified_base (253)..(253): a, c, t, g, unknown or other
  modified_base (540)..(540): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtgggaggaggcttgatccaggccgtgggggtccctgagactctcctgtncagtcctctggcttcaccgtcagtagcagctacatgctacgtggccgccaggctcggaggggtagggctgggagtgggtcctgtagttacttacacttcgtacgtaccactattaaccgtactccccggacccgtaggaacggggtcctacttaaaccgtctccaaccgagaacggtacctattacccgaaagactcgggtataacctcttaacaaaattcggaaaacctaacgtgaaacggaccgaccgaacttaccgacgggttccctttaatccgtgaaccggngaagtagtactcggcgggttacggtaccggcctaccgtccgttgtaaccgtacgttcgcgttcggtcgggtcggtccgtacg

SEQ ID NO: 409599 - DNA, 754 bp, Homo sapiens
  misc_feature: GZ8MTXP02G4LTM.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttggactccagccgtgggggtccctgagactctcctgtgcacgcctcgtggtcttccgaccgtcagtagcagctacatcgcacgtcggtccgccgacggcctaccggaggggaacggggcgtacgggtaggtcggggttcttacgtaagtttaacttttaacaaaccgttttccgtacggttaaccccaacgtaccttaacccgttaccgtacccccggaacccccgggttaggaaacccggggtacccgtaacttaaaccacgttccctaccgagaaccgtaacgtacgttaccggaaacgtaaaaccgacggggttataacttaccttaaacaaaagtacgtaaaacctaaaccgtggaacgacccggaccgaaccaaaccggtaccggttacttttacacgttggtacgacggtaacgtaaggtcgttaaacggtcggggtttacggggtacccggggtaccctacgtacccgtttacgtttaaccggtttaacgtcggttacttcggttcggggtaccggggtccggtttaccggg

SEQ ID NO: 409600 - DNA, 667 bp, Homo sapiens
  misc_feature: GZ8MTXP02IKCYD.3.82.H05.1.454.CMB.2.raw
  modified_base (306)..(306): a, c, t, g, unknown or other
  modified_base (503)..(503): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttacaaaaggtgtccagtgtggaggtgcgaggtggtggagacgtggaggaggcttgatccagccgtgggggtcctgacgactctcctgtgcagcctctggctccacgtcagtagcagctagatcgcacgtcgggtcccncgagctacggaaggggagggcgtagggaggtggtctacgtagtttaactttaacgaatttcgtaggtaaccaataatacctacgtcccgacccgtagaacgggcaaacttaaaccattacaccgtaagacgtacgtaacttaccgaagaaacgtacggtagtactactaaactaaaattaccggaaaacttaaccgnggaaacgaccgaccggaaaccgtacgtaacccggttacgttttaaacgtacgtggtacgtcggaaagtaggtacgttacgggaaacggttcggggttacccggaaccttaccgtaacccggttgttaaccgttacctacggttacgtccgtttacggcccgggg

SEQ ID NO: 409601 - DNA, 609 bp, Homo sapiens
  misc_feature: GZ8MTXP02IAKFH.3.82.H05.1.454.CMB.2.raw
  modified_base (267)..(267): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactgggaggaggcttgatccgagccgtgggggtccctgagactctcctgtgcagcctctggcttcnccgtcagtagcagctaacatcgcacgtcgggtccgccaggcctccgaggggaaggggctgggagtgggtctcgtagttattacacttcgtacggtaccatactactacctcccgacccgtgaaacgggcctaattaaccatccaccagacgacgacttccgaagaaacgtcggtgtaactcgttacaaaagtcgaaaaccaaccgtgagacgccgaaccgaacgtacgggccttttaagtaccgtggacgacgagagtacgtttacggacggttcggggttaccgggaccctcgtaccccgttggttcctacgttcgattccgtcggtcggggtcctccggg

SEQ ID NO: 409602 - DNA, 799 bp, Homo sapiens
  misc_feature: GZ8MTXP02JXCAZ.3.82.H05.1.454.CMB.2.raw
  modified_base (608)..(608): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtgggagggaggtcttgatccgaggccggtggggggtccctgagacctctcctgtgcagcctctggctcgaccgtcagtacgcacgtcgtaacattcgccctacggttccggggtccccgacccgtacggggtaccgtacccgggaaaggggggtaacgggggtccggtagggggtaacggggttccgggggtacctttaccggttaaaggttttaaccttttaacgtaacgtttaccgttaaccggggttaacccctaaacgtaactttacccgtaaacccctcccccgggaaccccggttacgggaaaccgggggtacccgtaaacttaaacccaacgttacccgtacccgaagggaaccggtacgtaacttacccggaaacggtaaccgtaacgggttntaaccgttacttaaacgaaaagtaccgaaacctaacgtacggaaggaccgtaccggaaccgtaaccgtaccgggttacccgtttagtacgtgttacggcgtaaggtacgtacgttacggtacggtcggggttaccggaaccccttcgaacccggttcggttcttacggtccgacgtttccgtcggtccggg

SEQ ID NO: 409603 - DNA, 673 bp, Homo sapiens
  misc_feature: GZ8MTXP02H8XXF.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgcttatttcaaaaggtgtccagtgtgaggtgcaggtggtggagactgggaggaggcttgatccagccgtggggtccctgagactctctgtgcagcctctggtcttcaccgtcagtacgcagcctacatcgcacgtcgggtccgccgaggcctaccggaggggaacggggcgtggggaggttgggcctagtaagtttaactttactaacgttcgttacggtaacctaactacttaaccgttacccgtccccggtaaccccggttaggaaaccggtacccgtaaacttaacccatccctaccagaacgacgtactaccgagaaacgtacggtattataccttacaaagtactaaaccaaccgtgaacgacggaccgaacgacgtaccggtactttacgtactgtgacgaagtacgtacgttacggtaacggttcggggtaccccggggtacttcccgtaccgtttacggttaacttccgttacgtacgtccgttcgggtacggggtacccgtccgg

SEQ ID NO: 409604 - DNA, 690 bp, Homo sapiens
  misc_feature: GZ8MTXP02IJZAH.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtgggagggaggcttggatccaggccgtggggggtccctgagactctcctgtgcagcctctggctcaccgtcagtgcagctacatgcacgtcgggtccgccgaggccgtaccggaggggaacggggcgtggggaggtcggggtctacgtagtttaatttacatttctacggtacctacactacctaccgtcccggtacccccggtagaaccggggtaccgtaattaacccacttcctaccgacgaggaaccgtagttacccgaagtaaccgtacgggttactacgttacctttaaccgaaaagttacgaaaccctaaccgtaggacgggaaaccgcccggaaacgaaccgtaccggggttaacctttagttaacgtcggtacgacggtaaggtacggtaacgtttcggggaacggtttcgggggtacccgggtaccttcctaaccggttcggttactacgttcgtacttccgtcggtaccggggg

SEQ ID NO: 409605 - DNA, 682 bp, Homo sapiens
  misc_feature: GZ8MTXP02JH830.3.82.H05.1.454.CMB.2.raw
  modified_base (275)..(275): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgcttatttcaaaaggtgtccagtgtgaggtgcagggtggtggagacgtgggaggaggtcttgactccgacggccggtcggggggtccctggacgtaccttctccgtgtcgacncgcctcgtggtcctcaccgtcaggtacgcacgctacagtcgacgacgttcgggaccgccgacggccgtaccggaggggacgggtcgtgggaggtggtctacgttagtttaccttactacgttcgtacgtaccacgtactcgtccctaccggacccggtagaaccgggctaaactaccactctaccgagaagtcgtaccgtacgacgaaacgtccggttataaacttcttaaacaaaacgtacgaaaccctacgaggaacgacgacccgaaacgacgtaccgggttaactttgtaacgttgcggtaacgaggtacgttacgttacgggtaacgggttcgggtcccggggtacctaccgtaacccggttgttaaccttcgggtactcggttaccgtcgggtacccgggg

SEQ ID NO: 409606 - DNA, 612 bp, Homo sapiens
  misc_feature: GZ8MTXP02JM7WD.3.82.H05.1.454.CMB.2.raw
  modified_base (251)..(251): a, c, t, g, unknown or other
  modified_base (276)..(276): a, c, t, g, unknown or other
  modified_base (357)..(357): a, c, t, g, unknown or other
  modified_base (525)..(525): a, c, t, g, unknown or other
  modified_base (542)..(542): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagcttgggtttccttgttgctatttcaaaaggtgtccagtgtgaggtgcaggtggtggagacgtggaggagcttgatccgagccgtgggggtccctgagctctcctgtgcngcctctggcttcgaccgtcagtacncagctacatgcacgtcggtccgccaggcctccggaggggaagggctgggagtggggtctcgtagtttacttacgactttcncggtaccatactacctcgtccgaccccgtagaacggccgtaattaaccgattccaccgagaacgcgtaaacgttccggaaagaactacggggtatacgttactacgtaaaagtcgaaacctaaacgtcgaacggacgtcccgaagaccgtacggtaccgtttatacgngttacggagacgacgtntacggtacggttcggtccggaaccttcccgacgttgtaactccgtacgctacgtcgtcggggcctaccgg

SEQ ID NO: 409607 - DNA, 745 bp, Homo sapiens
  misc_feature: GZ8MTXP02IVSHV.3.82.H05.1.454.CMB.2.raw
  modified_base (264)..(264): a, c, t, g, unknown or other
  modified_base (292)..(292): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggtagttttggctgagtcgttgggttttccttgttgcttatttacaaaaggtgtccagtgtgaggtgcgaggtggtggagacgtgggaggaggcttgatccgagccgtgggggtccctgagactctcctgtgcncgctctgcttcacgtcagtagcagctanatcgctacgtcggccgaccgacggccgtaccggaggggtaaggggtcgtagggtacggttcggtcttacgtagtttaacttaaccgtaacgtttcgtacgtaacctactaactacctaccgtccccggtacccgtacggaaccgggacctaaacttaaaccgacttaccgtaccgaaggtaaccgtacgtaacgtacccgaagtaaacgtcggttatactacttaaacgaaaacgtacgaaaccctaacgtacggaacgaaacccggacccgtaaccggtaacggttaaccggttacccgttttaaagtaccggttagacggttacggaaaggttaaacgtccggtttaacggggacggttttaccgggggttaccccggtaacccttcccggtaacccggtttacggtttaccttaaccgttccgtaacgttccggttaccgggttccgggg

SEQ ID NO: 409608 - DNA, 627 bp, Homo sapiens
  misc_feature: GZ8MTXP02FPQ2O.3.82.H05.1.454.CMB.2.raw
  modified_base (420)..(420): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctcgtgtctccaccgtcagtagcagctacatcgcacgtggtccgccaggcctccggaggggaggggctagggacgtggggtctacgtagtttaactttacaactttcgtacgtaccactatacccgtactccccggaacccgtggaaacgggaccgtacttaaaccnctacctaccgaagacggacgtaacttaccggaaagaaccgtacggttacgtacttcctaaacaaattacgaaaaccaacgtagagacgcccgtaacgaccgacgtacctttagtacgtgtcgacggagagtacgttggaggttcggtacggggtaccctcgaccgtttaggtcctacgttcgtacgtcgtcggtcgggtccggtccg

SEQ ID NO: 409609 - DNA, 656 bp, Homo sapiens
  misc_feature: GZ8MTXP02H831W.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctctgtgcagcctctggccttcaccgtcagtacgcagactacagtcgcacgtcgggtcccgccgaggcctccggaaggggaacggggctgggaggttcgggtctacgtaagtttattactaacttcgtacgtaccactactacctacctcccgaccgtaggaacggtaccgtaacttaaccatcctaccgaagacgactacgttaccgaacgtaacgtacggtataactaccgtttacaaaacgttacgaaaaccctaacaggtaagacgacccggaaacgaccgttacggtacctttaagttccgtaggtcggacgaaggtacgtacgttcggaacgttcgggtaccgggtaaccctccgttacccgtagttaaccgttacgtacgtacgtcgttacgtcggttcggtacccgg

SEQ ID NO: 409610 - DNA, 539 bp, Homo sapiens
  misc_feature: GZ8MTXP02JJTHR.3.82.H05.1.454.CMB.2.raw
  modified_base (255)..(255): a, c, t, g, unknown or other
  modified_base (369)..(369): a, c, t, g, unknown or other
  modified_base (391)..(391): a, c, t, g, unknown or other
  modified_base (395)..(395): a, c, t, g, unknown or other
  modified_base (399)..(399): a, c, t, g, unknown or other
  modified_base (405)..(405): a, c, t, g, unknown or other
  modified_base (408)..(408): a, c, t, g, unknown or other
  modified_base (412)..(412): a, c, t, g, unknown or other
  modified_base (414)..(414): a, c, t, g, unknown or other
  modified_base (417)..(417): a, c, t, g, unknown or other
  modified_base (419)..(419): a, c, t, g, unknown or other
  modified_base (422)..(422): a, c, t, g, unknown or other
tcagagacgcactccacgaccggtgctcgatttagtcgagctctctcgcggggggagaggagcccagcactgggattccgaggtgtttccgattcggtgatcagcactgaacacagaggactcaccatggagttttggctgagctgggttttccttgttgctatttcaaaaggtgtccagtgtgaggtgcaggtggtggagactggaggagcttgatccagcctgggggtccctgagactctctgtgcaagcctntggcttcaccgtcagtagcagctacagtgcatggccgccaggctccagggaagggctaggagtcgggctcgagttatttccaaatttctgtacacatacgtactccgacccgtnaaggccgattaaccatcgtacngaanactnacgaanagntatnanaananaanaacagagagacgacgacgacgtacgttactactagtgagagagtagtacgtacgtacggtacggtaccgtaccgtacctacgtaacgtactacgtacgtacgtacgtacggtcgtcg

SEQ ID NO: 409611 - DNA, 674 bp, Homo sapiens
  misc_feature: GZ8MTXP02G3VVK.3.82.H05.1.454.CMB.2.raw
  modified_base (265)..(265): a, c, t, g, unknown or other
  modified_base (601)..(601): a, c, t, g, unknown or other
  modified_base (617)..(617): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcgttgggttttccttgttgctatttcaaaaggtgtccagtgtgaggtgcaggtggtggagacgtgggagggaggcttgatccgagccggtgggggtccctggagactctcctgtgcagcctntcgtctcaccgtcagtagcagctacatgcacgtcgggtccgccgtaggccgtaccgaggggaacggggcgtaggggaggttggggttcctacggtagtttaactttacaaacgtttccgtacggtaaccctaacgtacttaaccctacccgtccccggtaacccccggtaggaaccggggacccgtaacttaaccctactaccctaaccgaggtaaacgacgtaaccttacggaaacgaacgtccgggtaagtacttactaacgtaaatacgaaacctaaccgtgaacgtaccggaccgaacgtacggtaccggttacctttagtacgtggtacgnggaatagtgttacggnggtcggggtaccggacctcgaccgttgtcgtacttcgacttcgtcggtcggggcctg

SEQ ID NO: 409612 - DNA, 652 bp, Homo sapiens
  misc_feature: GZ8MTXP02F8GVT.3.82.H05.1.454.CMB.2.raw
  modified_base (441)..(441): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagggtggtggagacgtgggaggaggcttgactccgaggccggtcgggggtccctgagtactctcctgtgcacgcctcgtggtcttcgaccgtcagtagcagctacagtcgcacgtcgggtccgccgaggcctaccggaaggggaacggggcgtagggaggtcggggttctacgtagtttactttactacgttcgtacgtaccactactacctacctcccggacccgtaggaaaccggtcccaattaaccnctcctaccgagacacgtacttacgaagtaactcgggtatacttactaacaaagtacgaaaccacgtgaagccgaccggaacgaccgtaccggttactttaagtacgtgagacgaagtacgtagttcggacggggttcggtaccgggtaccctccggtacccgtttaggtccttacggtacgtacttccggtcggtcggggccgttaccggg

SEQ ID NO: 409613 - DNA, 712 bp, Homo sapiens
  misc_feature: GZ8MTXP02GYRX7.3.82.H05.1.454.CMB.2.raw
  modified_base (304)..(304): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctcgtgccttcaccgtcagtagcacgctacatgcacgtcgggtcccnccgaggcctccgaggggaagggcgtgggaggtgggtcctcgtaggtacgttacagcgagtacggaatacattattaagtgacaagtacgtccggtagggaaacggggtccaaattcccaacctatccctacccgaagaacgtaactaaacttacccgaaaacgtaaaacctactttacctaggttaaacttaccttaaacaaaagttaccgaaacctacggtaacctagggaacgaccgggacccggaaaacgggacccgtaaaacccgggttcctttaccgttaaagtttaacccgttggggttacgtaacccggaaaggttaacggttaaacggtttaccccggggtaaaggggtttccccgggggtttaacccgggggaaaccccctttcccgttaaaccccggg

SEQ ID NO: 409614 - DNA, 672 bp, Homo sapiens
  misc_feature: GZ8MTXP02JIFD0.3.82.H05.1.454.CMB.2.raw
  modified_base (264)..(264): a, c, t, g, unknown or other
  modified_base (527)..(527): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcagggtggtggagacgtggaggaggcttgatccaggccgtgggggtccctgacgactctcctgtgcagcctntcgtcttcaccgtcagtagcagctacatgctacgtcgggtcccaccgacggccgtaccggaggggtaacggggcgtagggacggttcggggtactacggtaagtttaactttacgtaacgtttcgtacggtaacctactaacttaccgttacccgtacccggtaaccccggtaggaaccggggtacctaacgtttaaaccgactcctacccgaagacgtaacgtacgttaccgaacgaaaccgtacggtatactaccgttaanaaacgtagaaaccgaccgtagacgacgccgaacgacgtacgttcttaactactgtcgacgagacgtaacgttggaacggttcgggttaaccggggcctaccgtcccgttcggttaaccttcgtacgacttccgtcggttccgggg

SEQ ID NO: 409615 - DNA, 740 bp, Homo sapiens
  misc_feature: GZ8MTXP02H1R9U.3.82.H05.1.454.CMB.2.raw
  modified_base (636)..(636): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggtagttttggctgagtcgtttgggttttccttgttgtcttatttacaaaaggtgtccagtgtgaggtgcgaggtggtggagacgtgggaggaggtcttgatccgaggtccggttcgggggtccctggacgtactctccgtgtcgctacgtcctcgtggtccttcaccgtacagtacgcacgtctacagtcgactacggtcgggcccgccggacggccgtaccgggaagggggacgggtcggtagggtaggtcggtactacgttaagtttaactttacgtactttcgtaacgtaacctaacgtaacttacccgtacccgtaccccggtaccccgggtaagtaaacccggggtaccctaaacttaaacccgctccgtaaacccgaaggtacgtaaccgtaaccgttacgaaacggtaacgttcggtaacttacttaccgtaaataaacgtaacgaaacctacgaggacggaccgaacccgaacgtaccgtacggttactttagtcgngtacgtcgagtacgtaacgttgggtaaacggttccggggtaccgtaaccctcggttaacccgtttgttaacccttcggttacgcgtttccgtacggggtccggg

SEQ ID NO: 409616 - DNA, 666 bp, Homo sapiens
  misc_feature: GZ8MTXP02JYRHW.3.82.H05.1.454.CMB.2.raw
  modified_base (568)..(568): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccgagccgtgggggtccctgagactctcctgtgcagcctcgtggccttcaccgtcagtagcagctacatcgaccacgtcgggtccgccgaggcctaccggaggggaggggcgtgggaggttgggtctacgtaggtttatttaacgtaactttcgtacggtaacccaagtactaacctacccgtccccggacccccggtaggaaccggggccgtaacttaacccactcctccgaagtaccgacgtacttacccggaagaacctacggggtattacttcgttacaaaagttacgaaactaccggtaggaacgacgtacccggaacgacgtaccgggttctttaagtaccgngttacgacgagtaacgtcgttcggacggttcgggttaccgggacctccgtaacccgttggtaactttcgtacgacttcggtcggtcggggccctcggg

SEQ ID NO: 409617 - DNA, 642 bp, Homo sapiens
  misc_feature: GZ8MTXP02IWYBC.3.82.H05.1.454.CMB.2.raw
  modified_base (543)..(543): a, c, t, g, unknown or other
  modified_base (553)..(553): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggtagttttggctgagcttgggttttccttgttgctatttacaaaaggtgtccagtgtgaggtgcaggtggtggagacgtggaggaggcttgatccaggccgtgggggtcctgagtctctcctgtgcagcctcgtcggtcttcgacgtcagtgcagctacatcgactacggtcggccgccgacggccctacggaggggaacggggcgtaggggtgttgggtcctgtagttttattaacgtattcgtacgtacactacttacctaccgtcccgacccggtagaacgggacccgtaacttaaacctacttcctacgagaactacgtacgttacgaacgtaaacgtcggttatactttactaactaataacgaaacctaccgagacgacgaccggaccgtaccgtacggttacgtttntaacgttggngagagtagttcgtaggtacgggttacggtaccggtacctaccgttcgttcgttcgtacgttcgtacgttacggtcggtccggtcgtacg

SEQ ID NO: 409618 - DNA, 813 bp, Homo sapiens
  misc_feature: GZ8MTXP02I0W3P.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtgggaggaggcttggactccgacgtccggtgggggtccctggacgactctcctgtcgcacgcctctggtactcgaccgtcagtagcacgctacatcgcacgtcggtcccgcgacggcctaccggaggggaacggggtctagggtacggtcgggtccttacgtaacgtttactttaacgactttcgtacggtacctaactacttacccgtaccgtaccccggtaccccggtaggtaaaccgggtaccgtaaacttaaaccctagtacctacccgaagacggtaaccgtacgttaaaccgaagtaaaccgtcggtttacgtaaacttccgttaaaacaaacttaagaaaaccccgttaaactcgggaaacgaacccggtaccccggaaacggtaacgtaaccccgggggtttaaacctttagttaaccggtggttaacccggacggtaaaggtaacggttacgggtttaaacccgggtaggggtttcccgggggtttaacccgggggtaacccctttcccggtaaaaccccgggtttttcggggtttaaaccctttaaccgtttccggggttaaccttccccggggtttacggggttaccccgggggg

SEQ ID NO: 409619 - DNA, 773 bp, Homo sapiens
  misc_feature: GZ8MTXP02IUM4F.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtgggaggaggcttgactccgaggccgtgggggtccctgagactctcctgtcgcacgccttcgtcggtccttccaccgtcagtacgcacgtactacgatcgccgtacggtccgggtcccgccgacggtccgtaccggaaggggaacggggtcgtaggggtaggtcgggttcctacgttaagtttaacgttaactaacgtttcgtacggtaccaactaacttaccctacccgtcccgtaacccggtacggaaccgggtaccgtaactaacctacttaccctaccgaaagtacgaaccgtacgttaccggaaacgaacgtacgggttactaactaccgttaaacaaagttacgaaaacctaccgtaggaagaccggtccgaaccgaacgtaccggttacgtttaactacggtgtacgacgtggtaaacgtcgtttaacgggtcggttaccgggggtttaacccgggtaaccccttacgttaccccccgggttttaggtttaacccgtttacccgttaaccggttacgtttaccccgttaccgggggtttaccgggggaccccgtttcgggg

SEQ ID NO: 409620 - DNA, 544 bp, Homo sapiens
  misc_feature: GZ8MTXP02FI9YE.3.82.H05.1.454.CMB.2.raw
  modified_base (384)..(384): a, c, t, g, unknown or other
  modified_base (464)..(464): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtcagtgtgaggtgcaggtggtggagactggaggaggcttgatccagccgtgggggtccctgagactctcctgtgcagcctctggcttcaccgtcagtagcagctacatgcacgtgggtccgccaggctccgaggggaggggctgggagtgggtctcagttattacattctgtacacatactactccgacccgtgaaggccattaaccntctcagagacattcgaagaacacgtgtatcttacaaatgaaacaacctgagacgaccgagaccgacggtcctttattacngtgcgaagagattcggagttcggggttacgggacctcgacccttggtctaacgtttcgattccgcgttcggggccgtcgg

SEQ ID NO: 409621 - DNA, 695 bp, Homo sapiens
  misc_feature: GZ8MTXP02FT1NW.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgcaggtggtggagacgtgggaggaggcttgatccagccgtgggggtccctgagactctcctgtgcacgcctcgtggtccttcgaccgtcagtagcagctacatcgacacgtcgggtcccgccgacgccgtacccggaaggggtaacggggcgtaggggacggttggggttacctacgtagttttaacttacgtaactttcgtacgtaacctactactaaccttaccgtccccggacccgtaggaaacgggtaccctaacttaaaccgtactaccgtaccgaaagacgtaacgtacttaccggaagaaaccgtgggttactaactcgttaaacaaagttaccgaaaacccgtaaacgtcggaacgaccgtaccggaaaccgtaccgtaccgggttactttacgtacgtgacggacgtaagacgttacgttacggaggttccggggtaccggaccttacccgcctttagggtcttacggtcgagttccgtggtccggggctacccgg

SEQ ID NO: 409622 - DNA, 887 bp, Homo sapiens
  misc_feature: GZ8MTXP02HD2MT.3.82.H05.1.454.CMB.2.raw
  modified_base (262)..(262): a, c, t, g, unknown or other
  modified_base (264)..(264): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggtagttttggctgagcttgggttttccttgttgtctatttacaaaaggtgtccagtgtgaggtgcgaggtggtggagacgtgggagggaggcttgatccgacggccggtgggggtccctgagcctctcctgtncngcctcgtcggtctcacctcagtagcagtactacacgtcgaccgtaccggtacggggtccccgaccggacggtacccgtaccggggaagggggaacgggggtcgtaggggtacgggttcggggttaccttaccgtttaagttttaaacgtttttaacgtaaaccgtttaccgttaaccggttaacccctaaacgtaaccgttaaccccgttaacccgttacccccggggtaacccccggttaacggggtaaacccgggggtacccttaaaacctttaaacccgtaaaccttacccgtaaacccgaggttaaaccggtaacccgttaacggttaacccggaaacgtaaaaccgttacgggttacttaaccttaaccgttaaaacgaaaacgtttaccgaaaacccgttaccgagggtaaaccgacccggtaccgggaaaaccgtaaccgttacccggggtttaacctttttaacggtaacgttcgggtacgtaacgggaaacggttacgtacggtttaggggtaccgggggttacggggttacccgggtaccctacccggttacccgtttaacggttccttaacggtacgttcgttaccggtcggtacgggggtaccctaccggg

SEQ ID NO: 409623 - DNA, 762 bp, Homo sapiens
  misc_feature: GZ8MTXP02GP2NZ.3.82.H05.1.454.CMB.2.raw
  modified_base (547)..(547): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgcgaggtggtggagacgtgggagggaggcttgactccgaggtccggtcggggggtccctggacgaccttctcctgtgcacgtcctcgtggtccttcgacccgtcagtacgcacgctacgatcgccgtacggtcgggtcccgccgacggccgtaccggaagggggaacggggtcgtaggggtcggttcggggttcttacgttaagtttaactttaactaacgttcgtacggtaccactaacttaccctacgtccccggtaacccgtaggaaaccgggtacctaacttaacgactcccgtaccgaagacgtacgtaacgttaccggaaagtaacggtacggtagttaacctacttaaanaaacgtacgaaaaccctaacgtagaacgaccggaccggaaaccaaccggtaaccggttaccgtttaaataccgtggtaacggacgaaggtaacgttacggttaccgggttacgggttacgggggttacccggacccttacccggttaacccggttgtttaacccgttaactcggttacccgtcggtttaccggggtccgggtacccggtacccgg

SEQ ID NO: 409624 - DNA, 698 bp, Homo sapiens
  misc_feature: GZ8MTXP02G83Q6.3.82.H05.1.454.CMB.2.raw
  modified_base (461)..(461): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggtagttttggctgagcttgggttttccttgttgcttatttacaaaaggtgtccagtgtgaggtgcgagggtggtggagacgtggagggaggtcttgactccgaggtccggtcggggggtccctgacgtactctccgtgtgcacgtcctcgtggtccttcgaccgtcagtagcacgctacactcgcgacggtcggtcccgaccgacggtccgtaccggaggggaagggtcgtgggtaggtcgggtactacgtagtttatttactacttcgtacgtaccactactacctccgtccccggacccgtacggaaacggtaccgtaacttaacctacncctaacgagtaccgtacgtaacgttacgaacgaaccgtcgggttataaccgttctaaacgaaataaccggaaacctaaaccggtggaaccgtacgacccgggtaaacctaccggacggtttacctttaatacgtcggtagacgtagggacttacggttaggtcggtacggggttccggaccttccgtaccggtttcgtaacttaccggttctactcggttcggcgggttaccgtacg

SEQ ID NO: 409625 - DNA, 776 bp, Homo sapiens
  misc_feature: GZ8MTXP02IISXF.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactgggaggaggcttgatccaggccgtgggggtccctgacgacttctccgtgtgcacgcctcgtggtcttacgaccgtcgagtagcacgctacatcgacctacggtcgggtcccgaccggacggacccgttaccggaagggggtaaacggggtcgtaggggtagggttcgggttaccgttacgtaagtttaagttttaactaaccgtttcgtacggtacccacgtaacttaccgttacccgtcccgggtacccccgtagggtaaacccggggtaccctaaacgtttaacccgactttacccgaccgtaaaggaaccggtaacgtacgtttacccggaaagtaaccgtaccggggtttattaactaccgttaaacaaagttacgtaaaacccgtaacctggtaaacgaccgacccggaaccgtaaccgtccggtttaacgtttaacgttacgtagtacggacgtaaggtacgtagttacgggtaggtttaccgggggtaacggtacccttaccgttaccgtttcggttaacttaccggttacgacgtttccgttcgggtccgggtacgtttccggg

SEQ ID NO: 409626 - DNA, 671 bp, Homo sapiens
  misc_feature: GZ8MTXP02GKOTI.3.82.H05.1.454.CMB.2.raw
  modified_base (261)..(261): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccaggcgtggggggtccctgagactctctgtgcagcctcgtcncggggggttcaccgtcagtagcagtctacatcgcgaccgtcgggtcccgccgacggccgtaccggaagggggaacggggcgtgggaggtcgggttctacgtagtttaacttaactaactttccgtacggtaacctaactaacttaaccgttaccgtacccccggtaacccccggtacggaaccggggtaccgtaaccttaacctactacctaccgagacgacgtactacggaacgaacgtacggtgtaactcttacaactaacgaaacacgtagacgacgaccgaacgacgaacgttcgttacgttactgtacgacgagacgtagtacggtcggtcgggttaccgggtaccctaccgtaccgttcgtttccgttacgtttccgacgttcgtcggtcggggtccggtccgg

SEQ ID NO: 409627 - DNA, 692 bp, Homo sapiens
  misc_feature: GZ8MTXP02FS6LP.3.82.H05.1.454.CMB.2.raw
  modified_base (610)..(610): a, c, t, g, unknown or other
  modified_base (630)..(630): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagacgtggaggaggcttgatccgagccgtgggggtcctgagactctcctgtgcagcctctggcttcaccgtcagtagcagctacatcgcacgtcgggtccgccgacggccgtccggaaggggaacggggcgtaggggacggttcggggtacctacgtaagtttaacgtttaactaacgtttccgtacggtaaccctaacctacttaacccttacccgtccccgggtaacccccggtaaggggtaaaccggggacccgtaaactttaaacccgacttaccctacccgaaggtaaccgtaaccgtacgttaacccggaagtaaaccgtacgggttattaacttacgttaaacaaagttaccggaaactacctaggacgacgaccgtaacgaaccgtacggttacgttattacgngtagacgagtagtgtacggnggttacgggttcggccctacgtccgttgtcctacgttcgacttcgcggtcggggtccgtacg

SEQ ID NO: 409628 - DNA, 884 bp, Homo sapiens
  misc_feature: GZ8MTXP02GSZX1.3.82.H05.1.454.CMB.2.raw
  modified_base (309)..(309): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggtagttttggctgagtcttgggttttccttgttgtcttatttacaaaggtgtccagtgtgaggtgcgaggtggtggagacgtgggaggaggtcttgactccgacggccggttcgggggtccctggacgtactcctcctggtgcacgtcctcgtcgtcttcaccgtcagtcgcagtctacntcgccgacggtccggtccgccgacggtccgtacgggagggggaacgggtcggtagggtacgggttcggggtaccttaggttaacgtttacgtttaacgtaaccgtttccggtaacggtaacccctaacgtaaccttacccgttaaccccgtacccccggggtacccccgggttaaacgggtaccgggggtaccctaaacctttaaacccgtacgttacccgtaaacccgaagggtaaaccgtaacccggtaaacgttacccggaaacgttaaaccgtcggggtttaacgaaccctttaacgttaaacgaaaagtttacccgaaaaccgtttaaccgtcgggaaaacgacccgacccgggtaaaacgtaacccgggttaaccgggtttaaccgttttaaacggttacggtacggggttaacgacgggtaaggttaaaacggtaccgggttttcggggtaaacggggtttaacccgggggtcccggttaccctacccggttaaccgggtttccgttaacgttttaacccgtggttaacccgtcgggtttacccgggggccgggttaacccgtcccgg

SEQ ID NO: 409629 - DNA, 638 bp, Homo sapiens
  misc_feature: GZ8MTXP02H4FUF.3.82.H05.1.454.CMB.2.raw
  modified_base (302)..(302): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccgagccgtgggggtccctgagactctcctgtgcagcctctggcttcaccgtcagtagcagctacatgcacgtcggtccnccgagtccgtacgaggggaggggcgtgggagttcggggtctcgtagttttactttaactagtttcgtaggtaaccactactacctaccgttcccgaaccccggtagaaaccgggggtcctaaacttaaacccacttcctaccgaagtaacgacgtaagttaccggaagaactacgggttatacttcttaaacaaacgtacgaaactaaccgtggaacacggaccgaacgacgtaccgtacgtttatacgtggtcacgagagtacgtggtacgttcggggtccggtaccctcgtaacccgttcggtttacctacgttcgacgtttcgcggttcgggg

SEQ ID NO: 409630 - DNA, 866 bp, Homo sapiens
  misc_feature: GZ8MTXP02IL4U7.3.82.H05.1.454.CMB.2.raw
  modified_base (260)..(260): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttacaaaaggtgtccagtgtgaggtgcaggtggtggagacgtggaggaggcttgatccgaggccggtcgggggtccctgagtactctccgtgtgcncgtcctgtggcttcacgtcagtacgcagctacatcgcacggtcggtccgaccgtacggcctaccggaaggggaaggggtcgtaggggaggttcggggtacttacgtaaggttttaaactttaacgtaactttccgtacggtacctactaacttacctaaccgtccccggtaccccggtagggaaaccggggtacccgtaaacgttaaacccaacgttaccctaaccgaagtaaccggaacccgttaacgttacccgggaaaacggtaaaccgtaccggggtttattaaacgttaacctttaaccgaaaagtttaaaccgaaaaccctaaaccgtagggaaaccggacccggtaacccggaaacggtaacccgttaaaccgggttaccgtttttaaataccggttacgggtacggaacggttaacggtaaaacggttacggttaaccggggttacgggggttaccgggggtttaaccccggggaccccttttaacccggtttaccccgggtttaagggtttttaacccccgttaaccggggtttaccggttaaacctttcccgggtttaccgggggtttacccgggggtaccccggtttacccgggg

SEQ ID NO: 409631 - DNA, 935 bp, Homo sapiens
  misc_feature: GZ8MTXP02JDGDJ.3.82.H05.1.454.CMB.2.raw
  modified_base (255)..(255): a, c, t, g, unknown or other
  modified_base (267)..(267): a, c, t, g, unknown or other
  modified_base (271)..(271): a, c, t, g, unknown or other
  modified_base (284)..(284): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtggaggaggcttgatccagccgtgggggtcctgagacctctcctgtgcngctctggtctcnccgnagtagcagctacntcgcgtaccggtcggtccgaccgacggccctaccggggaaggggaaacgggggtccgtaggggtagggttcggggttacccttacggttaacggttttaaacttttaaaccgttaacgtttaccgttaaccggggttaacccctaaaccttaaactttaacccccgttaacccccgtacccccggggtacccccgggtaaacgggggtaaaacccggggtaccccggttaaaacctttaaaaccccgtacccggttacccttaacccggaaaacggtacccggtaaacccggtaaacccgttttacccggaaaaacggtaaaccccgggttacgggggtttaacgtttaaactttaaccgttaaaaccgttaaaaacgtaaccgaaaaaacccccgttaaacggttacgggtaaaacgggtaaccccggaacccccgggtaaaacccgtaaacccgggttaaacccggtttacccggtttttaaagtacccggttagggttacgaacgggtaacgtacggtaacggtttacggtaaacggggtttcgggggttaacccgggtacccgttaacccgttacccggtttacggtttaacccggttaacctttcggtaccttccggtcggggtccggggtcccggtttaacccgg

SEQ ID NO: 409632 - DNA, 590 bp, Homo sapiens
  misc_feature: GZ8MTXP02GHZ95.3.82.H05.1.454.CMB.2.raw
  modified_base (296)..(296): a, c, t, g, unknown or other
  modified_base (430)..(430): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagacgtggaggaggcttgatccagccgtgggggtccctgagactctcctgtgcagcctctggcttcaccgtcagtagcagctacatgcactgggtccncaggctccgaggggacgggctgggagtgggtctgagttatttacaattctacggtaccactactactactcccgaccccgtggaaacgggccgaacttaaccgatcctacagaacacgtacttcccgaagaacnccgggtatactacttagaaattacgaaacctaacgtgagacgcgaacgacgtacggctttaatacgtgagcgaagacgtattacggaggttcggtaccgggaccctctaccccgttggttaacttaccgttcgacgttccgtcggtcgggggtccgtcgg

SEQ ID NO: 409633 - DNA, 712 bp, Homo sapiens
  misc_feature: GZ8MTXP02GGFGF.3.82.H05.1.454.CMB.2.raw
  modified_base (258)..(258): a, c, t, g, unknown or other
  modified_base (278)..(278): a, c, t, g, unknown or other
  modified_base (290)..(290): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgcttatttcaaaaggtgtccagtgtgaggtgcaggtggtggagacgtgggaggaggcttgatccgagccgtgggggtccctgacgactctcctgtgcngcctcgtggtcttcaccgtnagtcgcagctanatcgcacgtcgggtccgaccgacggccgtaccggaagggggaacggggtccgtaggggtaggttcgggttccttacgtaaggtttaactttaacgtaacctttccgtacggtaacccaactaacttaaccgttacctcccccggtacccgtagggaaaccggggtaccctaaacgttaaacccacttccgaccgaagaaccggacgtaacgttccggaaagtaacgcggttataactccttaaacaaatacgaaacctaacgtgacgacgacccgacgacccgtcggtacgttttaacacgttggagtacgaagtacggtacgttgggaacgggtttcgggtacccgggtaccctccgttaacccgttggtttaaccctaccggttacgacgttccgtacgggtacgggggtactccccggg

SEQ ID NO: 409634 - DNA, 743 bp, Homo sapiens
  misc_feature: GZ8MTXP02GK2IJ.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagacgtggaggaggcttgatccagccgtgggggtccctgagactctcctgtgcagcctctggcttcaccgtcagtagcagctacatgcacgtcggtccgccgacggcctaccggaggggaacggggctgggaggtgggtcctagtaagtttaactttacaaactttcgtacggtaacctacgtactaaccttaccgtccccggaacccccggttagggaaaccggggacccgtaaacttaaacccgattcccgtacccgaaaggtaaacggaccgtaacttacccggaaagtaaaaccgaccggggtttattaacttaccgtttaaacaaaaacgttacgaaaaccctaaaccgttaggaaaccgaaccgggtaccccggaaaccgaaaccgtaccgggttaaccgtttttaactaacgttcggtacgtaccgggaaagtacgttagtttccgggaacgggtttcgggggttaccgggaccccttcgtaccccgtttgggttaaccttacgtttaccgattccggtcggtcgggggcccttacggg

SEQ ID NO: 409635 - DNA, 694 bp, Homo sapiens
  misc_feature: GZ8MTXP02HGB4X.3.82.H05.1.454.CMB.2.raw
  modified_base (498)..(498): a, c, t, g, unknown or other
  modified_base (523)..(523): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtgggaggaggcttgatccagccgtgggggtcctgagactctcctgtgcagcctctggcttcaccgtcagtagcagctacatgccacgtcgggtcccgaccgtacggccgtaccggaggggaacggggcgtaggggaggttgggtctgtaggtttaatttacaactttcgtacgtaacccatacttaacctacctccccggaacccgttagggaaaccgggtccctaagttaacccatccctacgaagaacgacgtacgttaccgaagtaaacgtacggttagtaacttcctaanaaaacttacggaaaccttaaaccgnggaaacggaccggacccgaaccgaaccggaaccggttaccgtttaataccggttgtacgacgtaaggtaacgtacggttcgggtacgggttacggggtccgggaacccttccgtaacccgtttcggttccttaacgtcgtacgttccgtcgggtacgggggtccttaccgg

SEQ ID NO: 409636 - DNA, 784 bp, Homo sapiens
  misc_feature: GZ8MTXP02IEZFJ.3.82.H05.1.454.CMB.2.raw
  modified_base (301)..(301): a, c, t, g, unknown or other
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggaagactggaggaggcttgatcagccgtgggggtccctgagacgtctctgtgcagcctctggcttcaccgttcagacgcacgctacatcgacacgtcgggtccnccgaaggcctaccggagggggaacggggcgtagggacggtcggggtctccgtaggtttaacttacaaacgtttcgtacgggtaacctactacttaaccgtaaccgtccccgtacccgggtaggaaaccgggacccgttaaactaacccgtaaattccgtaaaccccgaaggaaacgtaaacccgggtacttaaccccggaaacgggtaaaccccgtagggggtacttaacttacccgtttaaaaactaaaacgtaaaccgaaaacccgttaaaccggtagggaaaccggaaccgggacccgggtaaacgtaaccccggtaaccgggttaaccgtttaaacgttacggtaggtacggaacgtaacggtaacgttaccgggtttacgggtaacgggtccggggttacccggtacccttaccggtaccgttcggttaacccttacgttaccgtacgtcccggttaccgggtacggggccgtaccgg

SEQ ID NO: 409637 - DNA, 677 bp, Homo sapiens
  misc_feature: GZ8MTXP02JG4J3.3.82.H05.1.454.CMB.2.raw
  modified_base (303)..(303): a, c, t, g, unknown or other
  modified_base (513)..(513): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggtagttttggctgagtcttgggttttccttgttgcttatttacaaaaggtgtccagtgtgaggtgcgaggtggtggagacgtgggaggaggtcttgactccgacggtccggtcggggggtccctgacgtacctctccgtgtgcacgcctcgtggtcttcgaccgtcagtacncgacgactacatcgcacgtcgggtccgcgacggccgtacggaggggagggcgtgggacgtcgggtctacgtagttacttacgtacttcgtacgtacctaacgtactaccgtaccgtacccggtacccggtaggaaccgggtaccgtaaacttaaccctacgtaccctacgaacgtaacgtacgtacgttacccgagtaaacgtacggttntacttactagaaactacgaaacctcgtagacggaccgtaccgaaccgtacgtaccggtttcttaagtcgaggtccgaggagtagtaacggttcggaggtttccgggggtaaccgccttacggtaacccgttgttacttacggtcgtactttccggtcggtcggg

SEQ ID NO: 409638 - DNA, 696 bp, Homo sapiens
  misc_feature: GZ8MTXP02FWFB3.3.82.H05.1.454.CMB.2.raw
  modified_base (311)..(311): a, c, t, g, unknown or other
  modified_base (331)..(331): a, c, t, g, unknown or other
  modified_base (595)..(595): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttacaaaggtgtccagtgtgaggtgcgagggtggtgggagacgtgggaggaggtcttgactccgaggtccggtcggggggtccctggacgtacttctcctgtcgcacgtcctctcggtcttccaccgtcagtcgcacgctacagtcnccgtacgtcgggtccgccgnggcctaccggaggggaggggtcgtcgggaggtcgggtactattaggtttaacttactaacgtttcgtcggtaaccacgtacttaccgtacccgtcccggaacccggtacggaacgggtacccaactttaacccgattacccacgtaacgacgacgtacgttacccgaagtaacctaggttcgtaacttcttaaaacaagttaaccgaaacctaaacgtaggaacgacccggaccgaacgaccgtacgggttacctttaacgtgnggtacgacgaagtacggtagttacgggtcgggttacggttccgggacccttacgcccgtttacgttaactacgtcgtacttctcggggtcggccttaccgg

SEQ ID NO: 409639 - DNA, 718 bp, Homo sapiens
  misc_feature: GZ8MTXP02JKQCY.3.82.H05.1.454.CMB.2.raw
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtggagggaggtcttgatccgaggccggtgggggtccctggacgtactctccgtgtcgcacgtcctcgtcggcttcaccgtcagtagcagctacagtcgcgacgtcgggtccgccgacggtccgtcccggaaggggaacgggtcggtagggtacggttcggggtcctacgtagtttaacctttaaccgtaacgtttcgtacggtaaccctacgttaacttacccgttacccgtaccccggtaaccccgggtacggtaaccgggtaccctaaacgttaaacctaacgtcctacccgaagtaacgtacgtacgttaccgaaagtaacgtacggttagtactacttaaacggaaactagaaccctaacgaggaacgtacggacccgaacgtaccgtaccgggttactttaacgtgtacgtgtacggtaagacgtaacgttccggtaacgggttccggtaccggggaccttccgtaaccggtggttacctacgttcgacgttcgtcgggtcccgg

SEQ ID NO: 409640 - DNA, 741 bp, Homo sapiens
  misc_feature: GZ8MTXP02FG622.3.82.H05.1.454.CMB.2.raw
  modified_base (177)..(177): a, c, t, g, unknown or other
  modified_base (342)..(342): a, c, t, g, unknown or other
tcagagacgcactccacgaccggtgctcgatttagtcgagctctctcgcggggggggagaggagcccagcactgggattccgaggtgtttccattcggtgatcagcactgaacacagaggactcaccatggagttttggctgagcttgggttttccttgttgctatttcaaaaggtntccagtgtgaggtgcagggtggtggagacgtggaggagggtctttaggactcccacggtccggttggggggggttacccctggaacgtaccttcctcccgttggtcgcacgtcctcgtcggtcttcgacccggttcaggtagcagctacatgcacgtcgggtccncgacggcctaccggaaggggacggggtcgtagggacgtggggttcctacgagttttaacgtttacaacgtttcgtacggaccactactaaccctaccgtcccggacccccggtaggaacggggtaccctaattaaacccgattacctaccgaaagtaacgtaaccgtattacccggaaagtaaaccgacgggttattaaactcttaaacgtaaatacgaaacctaaccgtagacggacgacccgaacgtacccgtaaccggttacgttttaaaactcgtacgggtacgtacgaaagggtacttaacggttcggtaacggggttacggggttacccgggacccttaccgtaccgttaggtaaccctagttaccgactcgtacggcggggtcctaaccggg

SEQ ID NO: 409641 - DNA, 760 bp, Homo sapiens
  misc_feature: GZ8MTXP02FT35X.3.82.H05.1.454.CMB.2.raw
  modified_base (463)..(463): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttggatccgagccgtgggggtccctgagactctcctgtgcagcctcgtcggccttcgaccgtcagtacgcagctacagtcgctacgtcggtccgaccgacggcctaccggaggggaacggggcgtggggtaggtcgggtactacgttagtttaacttttaacgtaacgtttcgtacggtaccctaaacgtacttaccgtaccgtcccccggacccggtacggtaaccggggacctaacttaaacccgntaccgtaccaggaacgacgtacttaccggaataacgtacgggttattaactcgttaaactaaaagtacgaaaaccgtaaccgtagggaaccgaacggtaccccgaaacggtaaaccggacccggtttaaaccgttttaccgtaaagtttcgggtaacgaccgggtaacggttaggtaaaccggtttcgggtaaacggggtttacccgggggtaccccggggtaacccttcccggtaaacccgttttcggttacctttaaccccggtgttaacgtcccgtttacggggtccccggggg

SEQ ID NO: 409642 - DNA, 678 bp, Homo sapiens
  misc_feature: GZ8MTXP02HRY6D.3.82.H05.1.454.CMB.2.raw
  modified_base (262)..(262): a, c, t, g, unknown or other
  modified_base (273)..(273): a, c, t, g, unknown or other
  modified_base (289)..(289): a, c, t, g, unknown or other
  modified_base (516)..(516): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagtcttgggtttttccttgttgtctatttcaaaaggtgtccagtgtgaggtgcgaggtggtggagacgtgggaggaggcttgatccgagccggtgggggtcctgagactctcctgtgcngcctctgctcncgtcagtagcagctanactgccacggtcggtcccaccgaggtctccgggaggggacggggcgttagggaggtcgggtcttcgtaaggttttaactttacgtatttccgtacgtaacctacacttaccgttaccgtacccggtaccccgttagggaaaccgccgtaaaacttacccgatttccaaaccgaggaacgttacgaccgtttaccgaagtaaaccgtacgttagtacttaccgttaanaaacgtcggaaaactaccgtaggaacggacgaacccggaccgtaacgaacccgggttcttttaaacgcgtgtacggcggtaaacgtgtaaacgtttcgacgggtttccgggtacggccctacgtccgtttaggttcttacgtgtacgttcgtcgggtacggg

SEQ ID NO: 409643 - DNA, 702 bp, Homo sapiens
  misc_feature: GZ8MTXP02H21OM.3.82.H05.1.454.CMB.2.raw
tcagagacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtcctgagactctcctggtgcagcctctggccttcaccgtcagtagcagctaacatgcactcggggtccgccaggcctaccggagggggaaggggctagggaggtcggggtctacgaagtttatttaacaacgtttcacggttacccactaatacccgtaacctccccggaacccccgttaggaaaccgggggacctaactttaaacccatttacccacccaagaacggaaacggtacttacccggaaagtaaacgaaccgggttagtaactacttacaaaaagttcgaaacaaaccttggaacgacggacccgaaccgaacgtaaccgggtcccttttaaagtacttacggtagaccggaaagtagaccgtttgggaaaggtttcgggggtacccgggggtaaacctccgtaacccccgtttgggttaaccttacgtacggtacttccggttacgtcgggggacccgtcggg

SEQ ID NO: 409644 - DNA, 703 bp, Homo sapiens
  misc_feature: GZ8MTXP02H45BI.3.82.H05.1.454.CMB.2.raw
  modified_base (490)..(490): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccaggccgtgggggtccctgagactctcctgtgcagcctctggcttcaccgtcagtagcagctacatgcacgtgggtcccgccgaggctcggaggggaagggcgtgggaggtgggtctcgtagtttactttacgtaatttcgttacgtaccactactacctaccgtacccgaccccggtacgaacgggtaccgtaacttaacccatcctacccgaaggacgaaccgtacgttcccggaaagtaaaccgtacgggttatactaccgttaanaaaacgttcgaaaacctaaccgtggaaggaaccgtacccgaacggtaaccgtaaccgggtaccttttaagttaccgtgtacggtaacgtaacggtaggtaacggtttaccggacgggtttacgggggttacccgggggtaccccttaccggtaacccgtttcggggtttacccttaaccgtttcggtaactttccggtaccggttaccggggg

SEQ ID NO: 409645 - DNA, 790 bp, Homo sapiens
  misc_feature: GZ8MTXP02IVCH9.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgcaggtggtggagacgtgggaggaggcttgatccgaggccggtcgggggtccctgacgtacctctcctgtgcacgcctctcggtccttcaccgtcagtacgcagctacatcgccgtacgtcgggtccgccgaggtccgtaccggaagggggaacggggcgttaggggagggttcgggttacttacgttaaggtttaactttaacgtaacgtttccgtacggttaaccccaacttaacttaacccgttaccccgtcccccggggtaacccccggtaaggggtaaacccggggtacccccgttaaactttaaaccccgtacttacccgtaaacccgaaaggtaaaccggtaaacccgtacgttaacccgaaacggtaaaaccgttacgggtttataaccttaccttaaacgtaaaacgtaacgaaaaccctaccgtagggaacgaccggacccgaaaccgtaaccgtacccgggtttacttttaaacgtaccgttggacggacgtaaggtacgttacgtttacggcggtttaccgggttccgggtaacccttccgtacccgttgttaacctacttcgtacttcgtacggtcgggtccgtcgg

SEQ ID NO: 409646 - DNA, 594 bp, Homo sapiens
  misc_feature: GZ8MTXP02JW6NW.3.82.H05.1.454.CMB.2.raw
  modified_base (297)..(297): a, c, t, g, unknown or other
  modified_base (368)..(368): a, c, t, g, unknown or other
  modified_base (420)..(420): a, c, t, g, unknown or other
  modified_base (457)..(457): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctggggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactgggtccnccaggctccgaggggaaggggctgggaggtgggtctacgtagttatttacattctggtaccagatactacncccgacccgtaggacggccgataccatcctacagacgacgatccgaagaacncggtatatcttacaaaattcgaaacaacgtcgagacncggaacacgacggtccttatactagtgacggagcgtattggtaaacggttggggtttaccggggacccttaccgtaccccgttagggtttccctaacgttttaccgtactacgttccggtacgggggccttccgggg

SEQ ID NO: 409647 - DNA, 570 bp, Homo sapiens
  misc_feature: GZ8MTXP02JCZD0.3.82.H05.1.454.CMB.2.raw
  modified_base (284)..(284): a, c, t, g, unknown or other
  modified_base (286)..(286): a, c, t, g, unknown or other
  modified_base (441)..(441): a, c, t, g, unknown or other
  modified_base (484)..(484): a, c, t, g, unknown or other
  modified_base (488)..(488): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctattcaaaaggtgtccagtgtgaggtgcaggtggtggagacgtggaggaggcttgatccaggccgtgggggtcctgacgactctcctgtgcagcctgtggctccacgtcagtagcagctanangcacgtggtccgccgaggccgtcgaggggaacgggcgtgggagtggtctcgtagttactttacattctcgtacaacatacctaccgtccgacccgtgaacgggcctacttaaaccctccaacgagacgactataccgagaactgtcaactctaanaatacaaacacgtagacgacgacgacgacgtacgttactttanacgngacgacggtagacgttacgtcggaacggttccggggtaccgcctaccgtcgttggttacctcgtcgacgttccgtcggcggg

SEQ ID NO: 409648 - DNA, 703 bp, Homo sapiens
  misc_feature: GZ8MTXP02HX6VO.3.82.H05.1.454.CMB.2.raw
  modified_base (198)..(198): a, c, t, g, unknown or other
  modified_base (272)..(272): a, c, t, g, unknown or other
  modified_base (313)..(313): a, c, t, g, unknown or other
  modified_base (597)..(597): a, c, t, g, unknown or other
  modified_base (662)..(662): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggtagttttggctgagtcgttgggttttccttgttgcttatttacgaaaaggtgtccagtgtggaggtgngaggtgggtggagacgtggaggagcttgatccgacggccgggtcgggggtccctaggacgtactcctctgcgcncgtcctcgtcggtccttccgacgtcagtacgcacgctacgntacgcgtaccggtccggtccgaccgacgggtaccgaccggggtaaggggggaccggggtcggtaggggtaggtcggggtacgacggttaaaacggtaaacgggtaacggttccggtagtaccgtagtaaacgtaacgaccgacgacccgtacgacgtaaccgccggggtaccggtaggggggacgggtccgggtaccgactacggtccaacggaacggtaaacgaacttaaacgaaacgaacgaacgtgtaacctgtttaacgtctagtcgttagtaacgtaanaccgtagacgacgacggaacccgtacgaaccacggtaccttaattagtagtggaacgtgaaaagngaaagtaatacgttaagtaggtcgacgtacgtaacgtaagg

SEQ ID NO: 409649 - DNA, 608 bp, Homo sapiens
  misc_feature: GZ8MTXP02JRDI4.3.82.H05.1.454.CMB.2.raw
  modified_base (417)..(417): a, c, t, g, unknown or other
  modified_base (458)..(458): a, c, t, g, unknown or other
  modified_base (470)..(470): a, c, t, g, unknown or other
  modified_base (487)..(487): a, c, t, g, unknown or other
tcagagacgcactccacgaccggtgctcgatttagtcgagctctctcgcggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggaggcttgatccagccgtgggggtcctgagctctcctgtgcagcctctggctcgaccgtcagtagcagctacatgcacgtcgggtccgccgaggctccgaggggacgggctaggaggtggtctacgtagtttacttactattcgtacgtaccatactcctacgtccccggacccgtaggaaccggggtacctaacttaaacccgntcccgtaccgaagacgaacgtcgtacgacgaacacgggttntactaccttaanaaatcggaaacctacgnggacggaccacgacgtacgtacggttacttatcgtgacgtcgaagtacgtcgtaggtacggttacggccgtaccgtacgttaacgtgttaccgtacacggtaccttcggcgggttcccggg

SEQ ID NO: 409650 - DNA, 611 bp, Homo sapiens
  misc_feature: GZ8MTXP02IYYOY.3.82.H05.1.454.CMB.2.raw
  modified_base (282)..(282): a, c, t, g, unknown or other
  modified_base (433)..(433): a, c, t, g, unknown or other
  modified_base (536)..(536): a, c, t, g, unknown or other
  modified_base (588)..(588): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctattcaaaggtgtccagtgtgaggtgcgaggtggtggagacgtggaggaggcttgatccagccgtgggggtcctgagactctcctgtgcagcctgtcggcttcaccgtcagtagcagctanatgccacgtggtccgcgacggcctcccggaaggggacggggtcgtagggtaggttcgggtactacgtagtttagtttactaacgtttctacggtaccacgtattacctaccgtcccggaccccgtaggaaccgggccgtaacttaacccgnttacccacgaaggacgaaccgtactcgaaagaaaccgtcggtatactctaacaatacgaaactactagagacgacgacgacgacgttcttatagtgagacganacgtgttacggtgggtcggtaccgggtactccgtccgttggtcctaccgttnactcgtcggtcggggtccctacg

SEQ ID NO: 409651 - DNA, 699 bp, Homo sapiens
  misc_feature: GZ8MTXP02FH7DU.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtggaggaggcttgatccagccggtcgggggtccctgacgactctccgtgtgcagcctctggctcaccgtcagtagcagctacatgcacgtcggtccgccgacggccgtccggaaggggacggggcgtgggaggtcgggtctacgtagtttaactttactaacgtttcgtacggtaaccactactacctaccgtccggaacccgtaggacggtacctacttaacactacctaccgagtaacgtacgtacttaccggaagtaaccgacgggttactacgttacttaaacgaaagttaccgaaaacctaccggtaggaacgaccgggacccgaacggtaacccgtaaccgggttacttttaacgtaacgtggtacgtagaacgtaacggttacgttacggggtacggtttaccggggttaccggggacctttacccgtaccggtttacgttccgtacgtttaccgacgttccggtacgtcgggggtcccgttacggg

SEQ ID NO: 409652 - DNA, 684 bp, Homo sapiens
  misc_feature: GZ8MTXP02GILO0.3.82.H05.1.454.CMB.2.raw
  modified_base (253)..(253): a, c, t, g, unknown or other
  modified_base (274)..(274): a, c, t, g, unknown or other
  modified_base (443)..(443): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtgggaggagcttgatccagcgtgggggtccctgagactctcctgtgcngctctgtcttcacgtcagtancagctacatcgacacgtcggtccgccgaggcctaccggaaggggaacggggtcgtacggggaggttcggggttcctaccgtaaaggtttattttaaccgaagtttccgtacggtaacctactaactaacctaccgtcccgaccccgtaggaaacggtaccgactaaacngtccacgaaggtaacacgtacttaccgaacgaaacgtacggttgtaacttactaaactaaaagttacgaaaccaacgttagaaccggacgaacccgaacgtaacctcgggttaaccttttagtaacgtggtacgacgtaagaacggtcgtttacggtacggttacggggttacccgggaccttaaccgtccggtttaggttccgttaacgtcgtacgttctcgggtaccggggcgtaccgg

SEQ ID NO: 409653 - DNA, 625 bp, Homo sapiens
  misc_feature: GZ8MTXP02FGLMP.3.82.H05.1.454.CMB.2.raw
  modified_base (282)..(282): a, c, t, g, unknown or other
  modified_base (295)..(295): a, c, t, g, unknown or other
  modified_base (537)..(537): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagggtggtggagacgtgggaggaggtcttgatccgaggccgtgggggtccctgagactctcctgtcgcagcctcgtggtcttccgaccgtnagtagcagctacntgcacgtcgggtccgccacggcctaccggaggggaacggggctagggaggttgggtctacgtagtttaattacgactttccgtaggtaccactataccctacgtcccgaacccggtaggaacggacctaacttaaccactcctaccgagacgaccgtaatcccggaagtaaccgtggtatacttcgtaacaaagtacgaaaccaacgtgaacgacgaccgaagcctacggtcgtttaatcgngtgacgaagtcgtacgttggacgttcgggttaccgaccttcgaccgtttggttaacctacgttacgctcgttcggccgggtcgtacgg

SEQ ID NO: 409654 - DNA, 679 bp, Homo sapiens
  misc_feature: GZ8MTXP02FV9FF.3.82.H05.1.454.CMB.2.raw
  modified_base (207)..(207): a, c, t, g, unknown or other
  modified_base (292)..(292): a, c, t, g, unknown or other
tcagagacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctggtagggacagagtcgntatgacttggtcgggctacttcggtacggttttaacaggtattggttaagtctggtatcgaagcaacgaaaaccgagggaaaccncccccgtagtacgtttcctgatgtctgctgcactcccaccctgactaaagtcgacgtccatccagtacttcgacgtctacgtgtagaactcggtaacggacgtaagtcgttacctactcctacctaccacgtcacgacgtacgtacccttcgaccgtaaaccgccgttaagggtaaactttaccggttttacgaacctttaaaccgtttaaacttacggtttaactaaccgtaaaccgtaggtaccgttacggaacctacggttccccttaccccgtaccgtttaccgttaaccgggtttaccggggacgggtaacggggtaaaacccgtagggttaacggaaacgtaacgtaaaccgtaaaaccggtacgtaggtcggtactaacg

SEQ ID NO: 409655 - DNA, 547 bp, Homo sapiens
  misc_feature: GZ8MTXP02GHKG9.3.82.H05.1.454.CMB.2.raw
  modified_base (273)..(273): a, c, t, g, unknown or other
  modified_base (399)..(399): a, c, t, g, unknown or other
  modified_base (449)..(449): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtcctgagactctcctgtgcagcctctggcttcaccgtcagtancagctacatgcactggtccgcaggctccgagggaggggctgggagtgggtctcgagttatttacaatttctaggtaccactagtactactccgaccccgtgaacgggccaataaccatcctcagancgaatcgaagaacacggtagtatcgtacaaatacgaaacaacctgacganaccgacacgacggtcctttatactgtgcgtagagtattcggagtcggttcgggacgtcacccgtggtctacgtcgacttcgtcgtcgggggacgtcgg

SEQ ID NO: 409656 - DNA, 678 bp, Homo sapiens
  misc_feature: GZ8MTXP02G4C7G.3.82.H05.1.454.CMB.2.raw
  modified_base (196)..(196): a, c, t, g, unknown or other
  modified_base (280)..(280): a, c, t, g, unknown or other
  modified_base (283)..(283): a, c, t, g, unknown or other
  modified_base (294)..(294): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctggtttcctgtgctatttcaaaaggtgtccagtgtgaggtgcaggtgtgganactggaggaggcttgatccagtccgtgggggtccctgagactctcctgtgcagcctctggcttcaccgtcaagtgcagcctaanagncacgtcggccncgaggcgtacggaggggagggtcgtaggggacggttggtactagttaactttaacttaacgtacgttcgtacgtactaactacgtacctacccgtcccggtaaccggtaggaaccggtacctaaactaactactaccaacgagtaacgacgtaacgtacgaagtaacgtacggttataacgtactaaactaacgtaacgaaaccgtacgaggacgaccggtaacccggaacgtaccgttaccggttacgtttaacgtacggtcggtagaaccggtagtaacggttacgtacggggtaacggttccgggggtaaccgtaccctaccgttaccgttacggtaaccgttacgttacggacgttcggtccgggtacggggtccctcgg

SEQ ID NO: 409657 - DNA, 649 bp, Homo sapiens
  misc_feature: GZ8MTXP02GO0ZW.3.82.H05.1.454.CMB.2.raw
  modified_base (276)..(276): a, c, t, g, unknown or other
  modified_base (290)..(290): a, c, t, g, unknown or other
  modified_base (346)..(346): a, c, t, g, unknown or other
  modified_base (384)..(384): a, c, t, g, unknown or other
tcagagacgcactccacgaccggtgctcgatttagtcgagctctctcgcgggggagtcagacccagtcaggacacagcatggacatgagggtctccgctcagctcctggggctcctgctgctctggttcccaggttccagatgcgacatccagatgaccagtctccatcctccgtgtctgcatctggtagggacagagtcgctataacttgtcgggcgactcgcggttttaacagattggttgtctggtatcagtcaagaaaaccgaggggaaacnccccgtgagttccngatgtctgctgcatcccacctgacaaagtgacgtccatccagtatcagcgtcagtnagtcgtaggactagtacgttacacttctaccaacctancaacgctacgcctagacacgtaccgttaagaagtttacgttttacgaaacctttaactttaacgttagtttacgtaaaccgaaacgtacgggtacttacggtaacctaccggttcccctaccccgtccgtttaaccgttacccgggtttacgggggaaaccggggtaaaccgggggttaaaccgaaacgggggtaacggaaacgttaaccgttaaaaccgtaaaacggttaacgtcgggtacggtaccaccggttaccctaaacc

SEQ ID NO: 409658 - DNA, 692 bp, Homo sapiens
  misc_feature: GZ8MTXP02GV9R6.3.82.H05.1.454.CMB.2.raw
tcagagacgcactccacgaccggtgctcgatttagtcgagctctctcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgcgaggtggtggacgagtgggaggaggcttgatccaggccggtgggggtccctggacgacttcgtcctgtcgcacgtcctctaggtccttccgaccgtacagtacgcagctacatgacacgtcggcccgaccgaggccgtaccggagggggaacgggcgtagggtaggtggtcttacgtattacgtttaacaccgttcgtacgtacaacgtactactaccgtcccgtaccgtaggaaccggtacctaactaaccgctacctacgagacgtacgtactacggaacgtaacgacggttatacgttaactaacgaacttaaacgaaactaacgtacggaacgaccgaccggaacggaaccgtaccgttacgtttaacgtacgtgtaccgggtagacggtacgttacggtacggttacgggttccgggtaccgggggtccctaccggtccgtttacgggtaacctttaccgtacgttacgtcggtcggtccgggttccgacccggg

SEQ ID NO: 409659 - DNA, 649 bp, Homo sapiens
  misc_feature: GZ8MTXP02HO8GI.3.82.H05.1.454.CMB.2.raw
  modified_base (289)..(289): a, c, t, g, unknown or other
tcagagacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagtatggttagtctggtatcagcaagaaaccgagggtaaagcccctgacgttccngatgtctgctgcactccacctgacaaagtgacgtccatccagtactcagtcgtcagttagactcgtagggaacaggtacttaccacttccacctaaccctatcccaaggccctaagtccccgtgacgacgtaccgtagtaacgttacgttttacaaccgtttaaacttttaacttagttacgtaacgaaacgtacggtacctacggtaccgttaccgttacccgtccccgtaccgttaccggttaccggtttaccgggggaccgggtaaacggggtaaaccggtaaacgggggtacggaaacgtaaacgtaaaccggtaaaacgtacggttcgggaccgtacgtaccggacccgtaaccg

SEQ ID NO: 409660 - DNA, 658 bp, Homo sapiens
  misc_feature: GZ8MTXP02G6G37.3.82.H05.1.454.CMB.2.raw
  modified_base (215)..(215): a, c, t, g, unknown or other
  modified_base (254)..(254): a, c, t, g, unknown or other
  modified_base (297)..(297): a, c, t, g, unknown or other
  modified_base (453)..(453): a, c, t, g, unknown or other
tcagagacgcactccacgaccggtgctcgatttagtcgagctctctcgcgggggggagaggagcccagcactgggattccgaggtgtttccattcggtgatcagcactgaacacagaggactcaccatggagttttggctgagctgggttttcttgttgctatttcaaaaggtgtccagtgtgaggtgcaggtggtggagactggaggaggcttnatccagccgtgggggtcctgagactctctgtgcagcctntggcttcaccgtcagtagcagctacatcgacacgtcgggtccnccgaggctaccggaaggggaacggggctagggaggtcgggtctacgtagttatttacaacttcgtacggtaccatatacctaccgtcccgaccccgtaggaaccgggaccgtaacttaaaccgattcctaccagaacgacgaacttacccggaaanaaccgtacggtagtaacgttcttaacgtaaaataacgaaacctaaacctggaaacgacgaccggtaacgaccgaacggtcctttaattacgtgtgacgaggacgtagttacggtacggtgggggtttacccggggaccttacccgaaccccggtttgttaaccgttactaccggtacgtccgtccgggtcggggtaccgtaccgg

SEQ ID NO: 409661 - DNA, 593 bp, Homo sapiens
  misc_feature: GZ8MTXP01EQKNY.11.71.G05.1.454.CMB.2.raw
  modified_base (299)..(299): a, c, t, g, unknown or other
  modified_base (373)..(373): a, c, t, g, unknown or other
tcagcgagagataccacgaccggtgctcgatttagtgtcgtcgcaagagagaggggggagaggagcccagcactagaagtcggcggtgtttccattcggtgatcagcactgaacacagaggactcaccatggagtttgggctgagcgtggttttcctcgttagctctttaagaggtgtccagtgtcaggtgcaactggaggagtcgtgggggaggcgtggtccagcctgggaggtccctgagactctcctgtacagcctctggcttcaccttcatacctatggcatgcactgggtcccncagctcgaggcgagggggctgggaggtggggtggctagtttattcattagtgagtaggaaattgtactactttntattcagtacctcggtaggaacgggtccgtattccgaccgtctaccagacgaactaacttccacgacacacgtctgtacgtctagactaaatacgaaacacgaccgtaggaagacgtcgtacggacggaacgacggttcgtgttagttacgttacgttagttcgttacgtaaagttagtttaacgttagtaggttaggtaacggttaacgggtaacgggg

SEQ ID NO: 409662 - DNA, 606 bp, Homo sapiens
  misc_feature: GZ8MTXP01CSDOC.11.71.G05.1.454.CMB.2.raw
  modified_base (246)..(246): a, c, t, g, unknown or other
  modified_base (259)..(259): a, c, t, g, unknown or other
  modified_base (284)..(284): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggtttcgtcgttaggctctttaagaggtgtccagtgtcaggtgcaatggagagtctgggggagcgtggtccagcctgggagtccctgagactctcctgtacagcctntggcttcaccttnattaccatgcatgcactgggtcccncagactccgaggcgagggggctgggaggtggtgctagtttattctatagtagtagtaggtaaagtagtagtacttaacttattctacgtacgtaccgtacggtaacgggacgtacgtaccgtaccgtaccgtaccgacgacgaactaacgtacgtacgacgacgacgtacgtacgtactacgtacgtaactaaagtaacgaacgaacgacgtacgagacgacgtagacggacgacggtcgtgttagttacgttacgttagtacgttacgttaagttaagttaattagtaaggtaggtaggttacggtaacgggttcggttcg

SEQ ID NO: 409663 - DNA, 654 bp, Homo sapiens
  misc_feature: GZ8MTXP01EYZAE.11.71.G05.1.454.CMB.2.raw
  modified_base (260)..(260): a, c, t, g, unknown or other
  modified_base (265)..(265): a, c, t, g, unknown or other
  modified_base (298)..(298): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagttgggctgagctgggttttcctcgttgcttcttttaagaggtgtccagtgtcaggtgcaactggaggagtcgtgggggagcgtggtccagcctgggagtccctgagactctcctgacngcctntgtctcactcatactatgcatgctcgtcggccncagacctcgaggcggagggggtcgtgggaggtggggtcgacgtacgtttattagagtagtagtaaagtaagggtaattacgtacgttactttacttaacgttacgaacgtaccgttaccggtaggaacgggtaccgtacttcccgtacccgttacctaccgaagaacgtaacgtaacgttaccgacgaccaacggtacgtacgttacgtacgtacgtacgaactaaagtacgaaacgtacgaccgtaggaacgaacgtacgttaagggaaacggaccgtaccggtcgttaggttacggttaacgttaacggtaggtaacggtaacggtaaagttacgtttaacgttaaggtaaggg

SEQ ID NO: 409664 - DNA, 509 bp, Homo sapiens
  misc_feature: GZ8MTXP01A4UN6.11.71.G05.1.454.CMB.2.raw
  modified_base (288)..(288): a, c, t, g, unknown or other
  modified_base (477)..(477): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctctttaagaggtgtccagtgtcaggtgcaactggaggagtctgggggaggcgtggtccagcctgggaggtccctgagactctcctgtacagcctctggcttcaccttcattacctatggcatgcactgggtccnccagactccaggcagggggctggagtggggtggcagttattcatatgatggaaatagtgacttctattcagactccgtgagggccattcaccgtctccagacgacaattccaggcacacgctgtatctgggacaaatcgaacagcctgacgagctgaggacacggctgttgtattacgtgtgacgaagntttcataagaggtgacgtcgggggcgttaacg

SEQ ID NO: 409665 - DNA, 503 bp, Homo sapiens
  misc_feature: GZ8MTXP01ANNKR.11.71.G05.1.454.CMB.2.raw
  modified_base (425)..(425): a, c, t, g, unknown or other
  modified_base (430)..(430): a, c, t, g, unknown or other
  modified_base (432)..(432): a, c, t, g, unknown or other
  modified_base (439)..(439): a, c, t, g, unknown or other
  modified_base (441)..(441): a, c, t, g, unknown or other
  modified_base (448)..(448): a, c, t, g, unknown or other
tcagcgagagataccacgaccggtgctcgatttagtgtcgtcgcaagagagaggggagctctgggagaggagcccagcactagaagtcggcggtgtttccattcggtgatcagcactgaacacagaggactcaccatggagtttgggctgagcgtggtttcgcgttagctctttaagaggtgtccagtgtcaggtgcaactggaggagtctgggggagcgtggtccagcctgggagtccctgagactctcctgtacagcctctggctcaccttcattacctatggcatgcactggtccgccagactccaggcagggggctggagtggggtgcagttattcatatgaattgggaatgtgacttctattcagactccgtgaaggccgattcacgtctccagagacaatccagcacacgctgtatctnacaananacagacngngaagcgngaggacgacggcgttgttgttagttaagtgtgtagaagttattaagttaagtaag

SEQ ID NO: 409666 - DNA, 521 bp, Homo sapiens
  misc_feature: GZ8MTXP01ED4XO.11.71.G05.1.454.CMB.2.raw
  modified_base (305)..(305): a, c, t, g, unknown or other
  modified_base (478)..(478): a, c, t, g, unknown or other
  modified_base (485)..(485): a, c, t, g, unknown or other
  modified_base (491)..(491): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcgtgggttttcctcgttgctcttttaagaggtgtccagtgtcaggtgcaactggaggagtcgtgggggagcgtggtccagcctgggagtccctgagactctcctgtacagcctctggctcaccttcattacctatggcatgcacgtggtccncagactccgaggcgagggggctggagtgggtgctagttattcatatgaatagggaatagtgtacttctattcagactcgtgaaggcattcacgtctccagagacaactcaagcacgacgtctgtatctgacaaatgaaacagcctgagaagcgttaggacggacgaccgggtnttggttnttattntgtaagacgtaattattaacgttaagtaag

SEQ ID NO: 409667 - DNA, 524 bp, Homo sapiens
  misc_feature: GZ8MTXP01BSBGI.11.71.G05.1.454.CMB.2.raw
  modified_base (304)..(304): a, c, t, g, unknown or other
  modified_base (464)..(464): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcgtggtttcctcgttgctctttaagaggtgtccagtgtcaggtgcaactggaggagtcgtgggggagcgtggtccagcctggggagtccctgagactctccctgtacagcctctggctcaccttcattacctatggcatgcactgggtccnccagactccgaggcagggggctgggagtgggtggctagttatttcatatgaaatgggaatgtgacttctattcagactcgtgaagggcgattcacgtctccagagacaattccaaggcacgacgctgtatcctgacaatagaacagacctcgagaagcgngaggacgaaccgggtcgttgttgttagttaagtgtgagtaagttattaacgttaagtaag

SEQ ID NO: 409668 - DNA, 527 bp, Homo sapiens
  misc_feature: GZ8MTXP01B8FEW.11.71.G05.1.454.CMB.2.raw
  modified_base (351)..(351): a, c, t, g, unknown or other
  modified_base (455)..(455): a, c, t, g, unknown or other
  modified_base (487)..(487): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggagcgtggtccagcctgggaggtccctgagactctcctgtacagcctctggcttcaccttcattaccctatggcatgcactgggtccgccagactccgaggcaggggggctgggagtggggtggctagttattcatatgatggaaatgtnacttctattcagactccgtgaagggccgattcaccgtctccagagacaattccaggcacacgctgtatctggactaaatgaacagcctgacgagctggagacgnggctgttgtattacgtgtagacgttaaagttntttcgtagtaaggagggtgacggtaacgggggttctttcg

SEQ ID NO: 409669 - DNA, 549 bp, Homo sapiens
  misc_feature: GZ8MTXP01DUYIF.11.71.G05.1.454.CMB.2.raw
  modified_base (305)..(305): a, c, t, g, unknown or other
  modified_base (346)..(346): a, c, t, g, unknown or other
  modified_base (370)..(370): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggagtccctgagactctcctgtacagcctctggctcaccttcattacctatggcatgcacgtggtccnccagactccgaggcgagggggctggagtggggtgctagttnttcatatgaatggaatgtgacttntattcagtactccgtgaaggccgattccaccgtctccgagacgacaaacttcccaggccacgacggtcttgtactctgacaaagtacgaacagcctaggagaagcgttaggacggaccgagggtcttaggttcgttagtttaacgtggtaagtacgaaagttagttttcaagttaaggg

SEQ ID NO: 409670 - DNA, 522 bp, Homo sapiens
  misc_feature: GZ8MTXP01BVZW9.11.71.G05.1.454.CMB.2.raw
  modified_base (307)..(307): a, c, t, g, unknown or other
  modified_base (368)..(368): a, c, t, g, unknown or other
  modified_base (443)..(443): a, c, t, g, unknown or other
  modified_base (454)..(454): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagcctggggagtccctgagctctcctgtacagcctctggctcaccttcattacctatggcatgcacgtgggtcccnccagactccgagggagggggctgggagtgggtgctagttacttcatatgataggaaatgtnacttctattcagactcgtgaggcatcaccgtctaccagagacatccaggcacacgctgtatctgacaaatgaacngtcctagacgngctaggacggacgcggctggttgttattaccgtgtgaacgtaaagtatttactaagttaaggtaaggg

SEQ ID NO: 409671 - DNA, 592 bp, Homo sapiens
  misc_feature: GZ8MTXP01EGSN4.11.71.G05.1.454.CMB.2.raw
  modified_base (147)..(147): a, c, t, g, unknown or other
  modified_base (246)..(246): a, c, t, g, unknown or other
  modified_base (248)..(248): a, c, t, g, unknown or other
  modified_base (265)..(265): a, c, t, g, unknown or other
  modified_base (272)..(272): a, c, t, g, unknown or other
  modified_base (288)..(288): a, c, t, g, unknown or other
  modified_base (311)..(311): a, c, t, g, unknown or other
  modified_base (328)..(328): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggttttcncgttagctctttaagaggtgtccagtgtcaggtgcaactggaggagtcgtggggggaggcgtggtccagcctggggagtccctgagactctcctgtacncncctctgtcttcaccttnatactangcatgcacgtcggccncagctcgaggcggaggggctggnggtggtgctagttattnatagtgagtaggtaaatgtcgtacttactatcgacgtaccgttacggaggaacgggtcctacttcctaccgtcacgagacactaactaccgacgacacgacgtctagtactactacggtaactaacgtaacgaacgacgacgtacgagacgacgtagacggacgacggtcgtcgttagttacgttacgtacgtacggttacgttaacgttacgttaagttagtaaggtacgggtacgggttacgggttaacggggttcggttcg

SEQ ID NO: 409672 - DNA, 633 bp, Homo sapiens
  misc_feature: GZ8MTXP01AR0V4.11.71.G05.1.454.CMB.2.raw
  modified_base (244)..(244): a, c, t, g, unknown or other
  modified_base (264)..(264): a, c, t, g, unknown or other
  modified_base (281)..(281): a, c, t, g, unknown or other
  modified_base (307)..(307): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggtttcgcgttaggctctttaagaggtgtccagtgtcaggtgcaactggaggagtcgtgggggagcgtggtccagcctgggaggtccctgagactctcctgtacngctctgctcacttcatactngcatcgcacgtcggccncagcctcgaggcggagggggctgggnggtggtggtcgtagttagttactagtagtagtagtaggtaagtagtagtacttaacttacgttcgtacgtaccgtaccggtacggtacgggtaccgtacgttaccgtaccgtaccgtaccgacgacgaactaacgtaccgacgacgacgacgtcgtacgtactacgtacggtactaacgtacgaacgacgtacgtacgacggacgacgtacggacggacggtacggtaacgtacgttagttacgttacgttacgtacgttacgttaacgttacgttaacgttagtaacggtaggtacggttacgggttaacggggttcggttaacg

SEQ ID NO: 409673 - DNA, 606 bp, Homo sapiens
  misc_feature: GZ8MTXP01BVI74.11.71.G05.1.454.CMB.2.raw
  modified_base (247)..(247): a, c, t, g, unknown or other
  modified_base (292)..(292): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagcctgggagtccctgagactctcctgtacngcctctggcttcaccttcattacctatggcatgcacgtgggtccncagacctccgaggcgagggggctgggagtgggtgctagtttattcatatgataggaaaatgtgaactttctaattcagtaccgtccggtagaacgggccgattccaccgtctccgagacgaactaacgttccaggcaacgacgctagtatctaggacaaatcgaaacacgcctggaagacgcgtaggaacggacaacggggtcttggttacggttaaactttacgtaggtagttaaaccgttaaaaggttacttttaataaggttaagggtaacgggttacggaacgggtttaaccgggggttcgtttaaccgg

SEQ ID NO: 409674 - DNA, 545 bp, Homo sapiens
  misc_feature: GZ8MTXP01EV7TC.11.71.G05.1.454.CMB.2.raw
  modified_base (277)..(277): a, c, t, g, unknown or other
  modified_base (297)..(297): a, c, t, g, unknown or other
  modified_base (360)..(360): a, c, t, g, unknown or other
  modified_base (365)..(365): a, c, t, g, unknown or other
  modified_base (412)..(412): a, c, t, g, unknown or other
  modified_base (432)..(432): a, c, t, g, unknown or other
  modified_base (447)..(447): a, c, t, g, unknown or other
  modified_base (455)..(455): a, c, t, g, unknown or other
  modified_base (458)..(458): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtgggttttcctcgttgctctttaagaggtgtccagtgtcaggtgcaacgtggaggagtcgtggggggaggcgtggtccagccgtgggaggtccctgagactctcctgtacagcctctggcttcaccttcattaccctanggcatgcacgtcgggtcccnccagacctccgaggcgagggggctgggagtgggtgctagttattcatatgaataggaaatgtnacttntattcagtacctcgtaggaacggggctattccaccgtctaccagganacaattaccagcacacgctntactctggactaaanagaacacncgngagagcgtagagacgcgtgtgttagtagttagtgtagacgttaagttattaatagtaagtaggtaggttacggtaacgggttcggtg

SEQ ID NO: 409675 - DNA, 551 bp, Homo sapiens
  misc_feature: GZ8MTXP01EXQP0.11.71.G05.1.454.CMB.2.raw
  modified_base (247)..(247): a, c, t, g, unknown or other
  modified_base (274)..(274): a, c, t, g, unknown or other
  modified_base (293)..(293): a, c, t, g, unknown or other
  modified_base (355)..(355): a, c, t, g, unknown or other
  modified_base (404)..(404): a, c, t, g, unknown or other
  modified_base (508)..(508): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagcctgggagtccctgagactctcctgtacngcctctggcttcaccttcattacctanggcatgcacgtgggtcccncagacctccgaggcgagggggctgggagtggggtgctagttattcatatgactggaaatgtntacttctattcagtacctccggtgaacgggccattcaccgtctccaganacattaccaggcacacgctagtatctaggactaaatgaacacgcctagagagcgtaggaggaccgacgggtctggttgtattacgtggtacgacgttaaagttntttaacgtataaggaggtcgacggttaacgggggttcgtttcg

SEQ ID NO: 409676 - DNA, 530 bp, Homo sapiens
  misc_feature: GZ8MTXP01DEFE6.11.71.G05.1.454.CMB.2.raw
  modified_base (274)..(274): a, c, t, g, unknown or other
  modified_base (293)..(293): a, c, t, g, unknown or other
  modified_base (399)..(399): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtggggggaggcgtggtccagcctgggagtccctgagactctcctgtacagcctctggcttcaccttcattacctanggcatgcacgtgggtcccncagacctccgaggcgagggggctgggagtgggtggctagtttattcatatgatggaaatgtgacttctattcagactcgtagaacgggccattccacgtctcaganacaatcaggcacacgctgtatctggactaaatgaaacagcctagagagctaggaggacacgggcttgttgtattacgtgtgacgaaagttatttctaataaggagggtgacgggttaacgggggcgtttcg

SEQ ID NO: 409677 - DNA, 526 bp, Homo sapiens
  misc_feature: GZ8MTXP01EEIYC.11.71.G05.1.454.CMB.2.raw
  modified_base (293)..(293): a, c, t, g, unknown or other
  modified_base (495)..(495): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccaggcctgggaggtccctgagactctcctgtacagcctctggcttcaccttcattacctatggcatgcacgtgggtcccnccagacctccgaggcgagggggctgggagtgggtgcagttatttcatatgatggaaatgtgtacttctattcagtactccgtagaagggccattccaccgtctaccagagacaattaccaggcacacgctgtatctaggacaaatagaacagcctgagagctgacgacacggctgttgtattacgtgtgacgaagttatttntataagaggtgacgtaacgggggttcgttcg

SEQ ID NO: 409678 - DNA, 602 bp, Homo sapiens
  misc_feature: GZ8MTXP01AWLEW.11.71.G05.1.454.CMB.2.raw
  modified_base (252)..(252): a, c, t, g, unknown or other
  modified_base (294)..(294): a, c, t, g, unknown or other
  modified_base (344)..(344): a, c, t, g, unknown or other
  modified_base (358)..(358): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggagtccctgagactctcctgtacagcctntggcttcaccttcattacctatggcatgccacgtgggtcccnccagacctccgaggcgagggggctggaggtggggtgctagtttattcatntgataggaaatgtnactttctattcgagtaccttccggtaggaaacggggccctaaattcccacccgttctaccaagacgtaaccaattccaggccacacgctgtactctagacaaatcgaaacacgcctagagacgcgtaggaacggaccgacggtcttaggttagttacttacgttaggtacgacggttaaagttacgttttaacgtaagttaacggtagggttcggaaccggttaacgggggttccgtttaacgg

SEQ ID NO: 409679 - DNA, 522 bp, Homo sapiens
  misc_feature: GZ8MTXP01AQKYR.11.71.G05.1.454.CMB.2.raw
  modified_base (302)..(302): a, c, t, g, unknown or other
  modified_base (441)..(441): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggagcgtggtccagcctgggagtccctgagctctcctgtacagcctctggctcaccttcattacctatggcatgcactgggtccnccagactccaggcagggggctggagtgggtgctagttattcatatgaaatggaatgtgacttctattcagtactcgtagagggcgatccacgtctccagacacaattccagcacgacgctgtactctgcaaatgaaacngcctagagaagcgttaggacgacgaccggattggttgttattaactggtaagacggtaaattctttaacgttaagtaaggg

SEQ ID NO: 409680 - DNA, 761 bp, Homo sapiens
  misc_feature: GZ8MTXP01DNPE9.11.71.G05.1.454.CMB.2.raw
  modified_base (264)..(264): a, c, t, g, unknown or other
  modified_base (703)..(703): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggagtccctgagactctcctgacncgcctcgtcgtctcctaccttctaacttacctagtcggactagtcgaccgtaccggttccggggtaccccgaccgaacgtaccccgtacccgggaacgggggaccggggaacggggggtcgttagggggtacgggttcgggggttacggtacgtttaaacggtttttaactttacgtaaagtttaagtaaggtaaaaggttaaagggtaaagtttacggtaacgtttaaccttttacttaacgttaccgaaacggtacccgttaccgggtaacgggtaaaccgggtaccgtaacgttacccgtacccgtacctaccgaacggaaacgaaccgtaaacgtaccgacgaccaaccggtacgtacgttagttactacgtacgaaactaaagtaacgaaactacgtaccgtaggaagaacgtcgagggaacggacgaccggtnttaggttagttacgttaacgtggtaacgaacgtaaagttactttaacgttaagtaagg

SEQ ID NO: 409681 - DNA, 580 bp, Homo sapiens
  misc_feature: GZ8MTXP01BETEK.11.71.G05.1.454.CMB.2.raw
  modified_base (244)..(244): a, c, t, g, unknown or other
  modified_base (249)..(249): a, c, t, g, unknown or other
  modified_base (271)..(271): a, c, t, g, unknown or other
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggtttcctcgttgctctttaagaggtgtccagtgtcaggtgcaactggaggagtcgtgggggagcgtggtccaggcctggggagtccctgagactctcctgtacngcctntggcttcaccttcattacctancggcatgcacgtgggtcccncagacctccgaggcgagggggctgggagtggggtggctagtttatttcgatatgataggaaatgtgactttctattcagtacctccggtaggaaacggggccctatttcccaccgttctaccgagacgactaattcccgaaggcacacgctagtactcgtaggacaaaatcgaaaccagtccgcgagagacgtagacggacgacggtcgtgttagttagttacgtagtagttacgttaagttattaattagtaaggtaggtacggttacgggtaacggggttcggttcg

SEQ ID NO: 409682 - DNA, 585 bp, Homo sapiens
  misc_feature: GZ8MTXP01AZUIO.11.71.G05.1.454.CMB.2.raw
  modified_base (245)..(245): a, c, t, g, unknown or other
  modified_base (291)..(291): a, c, t, g, unknown or other
  modified_base (355)..(355): a, c, t, g, unknown or other
  modified_base (362)..(362): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctcctgtacngcctctggcttcaccttcattacctatggcatgcacgtgggtcccncagacctccaggccgaggggggctgggagtggggtgctaggtttattcatatgatggaaatgtnactttanattcagtacctccggtaggaacgggccgaattccacccgtctaccgagacgaacaacttaccgaggaccacacgctagtatcctggacaaatgaaacgacgaccgtgaggagtccgtaggaacggacgacggtcgtgttaggttacttacgtgtacggacgttaaagttatttaacgtagttaaggtagggtggttacgggtaaccgggggttcgtttaacgg

SEQ ID NO: 409683 - DNA, 605 bp, Homo sapiens
  misc_feature: GZ8MTXP01CLUOL.11.71.G05.1.454.CMB.2.raw
  modified_base (256)..(256): a, c, t, g, unknown or other
  modified_base (302)..(302): a, c, t, g, unknown or other
  modified_base (474)..(474): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggacgtccctgagctctctgtacngcctctggcttcaccttcatacctatggcatgcacgtcgggtcccnccagacctccgagggcgagggggctgggagtgggtgctagttattcatatggataggaaaattgtagtactttctattcagtctccggtaggaacgggccgtattccgacccgtctaccgagacgactaacgtccacggcacgacgctagtactctagacaaagtcgaaacncgaccgtagacgtaggctagggacggaaccgtacgggcttaggttagttaacgtttacgttgttagttaccggtaaaagttattttaacgaagttacgggttaagggtaacggaaccgggtttaacggggg

SEQ ID NO: 409684 - DNA, 684 bp, Homo sapiens
  misc_feature: GZ8MTXP01DS683.11.71.G05.1.454.CMB.2.raw
  modified_base (292)..(292): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagcctgggagtccctgagactctcctgtacagcctctggtcttcaccttcattaccatggcatgcacgtcgggtcccncagacctccgaggcgagggggctggaggtgggtgtctagtttatttcaattatgtaataggaaaacttggtatacttacttattcgagtacctccggtaggacgggcctattccaccgtctaccgagaacgaactaacgttaccgaggtaccaaccgacgtacctagtaacttaccgtagggtaactaaaagttacgaaaccgacgtacccgtaggaaggaacgtaccggtagggaaacgggtaccgaaccggggtaacgtttaggttacgttaaacgtttacggtacgggttaggttaaaccggttaaaacggttaattttaaccgtaaaggttaacgggtaaggggttacgggttaaaccgggtttaacggggggttccgttttaaccgg

SEQ ID NO: 409685 - DNA, 571 bp, Homo sapiens
  misc_feature: GZ8MTXP01EF6NJ.11.71.G05.1.454.CMB.2.raw
  modified_base (257)..(257): a, c, t, g, unknown or other
  modified_base (262)..(262): a, c, t, g, unknown or other
  modified_base (275)..(275): a, c, t, g, unknown or other
  modified_base (303)..(303): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagcctgggagtccctgagactctcctgtacngcctntggcttcaccttnatacctatggcatgcacgtcgggtcccnccagacctccgaggccgagggggtctgggaggttggggtgctagttattcatatggataggaaatgtagacttctattcgagtacgtccggtaggaaacgggtccgtattccgaccgtctaccagacgaactattccaggcacacgactgtatctagacaaatgaacagcctagagtagctaggaggaacgacggctgttgtaattacgttagttcgaacgtaaagtatttaacgtaagtaggaggttcggttaacggttaacggggg

SEQ ID NO: 409686 - DNA, 556 bp, Homo sapiens
  misc_feature: GZ8MTXP01CUYA0.11.71.G05.1.454.CMB.2.raw
  modified_base (293)..(293): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtggggggaggcgtggtccagcctgggagtccctgagactctcctgtacagcctctggccctcaccttcattaccctatggcatgcacgtgggtccncagactccgaggcgagggggctgggagtgggtggctagttatttcatatgataggaaatgtgactttctattcagtactccggtagaacgggcctatccaccgtctaccagagacaattccaggcacacgctgtatctggacaaatagaacagcctgagagctgaggaccacggtctggttgtaattacgtggtgaacgttaaagttactttaactaagtaaggtagggtcgttacggttaaccgggggttcgttttaaccgg

SEQ ID NO: 409687 - DNA, 599 bp, Homo sapiens
  misc_feature: GZ8MTXP01DCB4S.11.71.G05.1.454.CMB.2.raw
  modified_base (305)..(305): a, c, t, g, unknown or other
  modified_base (311)..(311): a, c, t, g, unknown or other
tcagcgagagataccacgaccggtgctcgatttagtgtcgtcgcaagagagaggggagctctgggagaggagcccagcactagaagtcggcggtgtttccattcggtgatcagcactgaacacagaggactcaccatggagtttgggctgagcgtggtttccgtcgtaggctctttaagaggtgtcagtgtcaggtgcaactgggaggagtcgtgggggaggcgtggtccaggcctgggaggtccctgagctctcctgtacagcctctggctcaccttcattacctatggcatgcactggtcccncagacncgaggcgagggggctggaggtggtggtcgtacgttattatatatagtaagtagtaagtaagtagtacttactacttacgtacgtacgtaccgtacggtaacgggtaccgtacgttaccgtaccgtaccgtaccgacgaacgaactaactaccgtacgacgacgacgtacgtacgtacgtacgtacgacaactaacgaacgtaacgacgtacgaagaagacgacggacggacgtacgtcgttgttgttagttaagtagtaacgtagtaagttattaacgttaagtaagg

SEQ ID NO: 409688 - DNA, 551 bp, Homo sapiens
  misc_feature: GZ8MTXP01DAXFY.11.71.G05.1.454.CMB.2.raw
  modified_base (276)..(276): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtggggggaggcgtggtccagccgtgggagtccctgagactctcctgtacagcctctggcttcaccttcattacctanggcatgcacgtgggtcccgccagacctccgaggcgagggggctgggaggtgggtgcagtttattcatatgaataggaaatgtagtacttactattcagtacctccggtagaacgggcctattccaccgtctccagagacaatccagcacacgctgtatctaggacaaatagaacagcctgagagctaggacggacaggtctgttgttattacgtgtagacgttaaagttatttaactaagtaaggtaggtggttacggtaacgggggttcgttcg

SEQ ID NO: 409689 - DNA, 600 bp, Homo sapiens
  misc_feature: GZ8MTXP01ECTHC.11.71.G05.1.454.CMB.2.raw
  modified_base (313)..(313): a, c, t, g, unknown or other
  modified_base (387)..(387): a, c, t, g, unknown or other
  modified_base (421)..(421): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtgggaggagtcgtgggggagcgtggtccagccgtggggagtccctgagactctcctgtacagcctctggctcaccttcattacctatggcatgcacgtcgggtcccnccagacctccagggcgaggggggctgggagtggggtgctaggtttatttcatatgaattaggaatgtagacttntaattcagactccgtagaaggcgattccacgtcnccagacgacattccaggcacgacgctgtactcgtagacctaaatacgaaactaggtaccctaggagaacgtcgttagggaacgggttaaaccgtaccggggtcttacgggttgttaaacgttttaaccgtggtaaggtaaaccgtaaaagggttattttccgttaaaggttaaaggggg

SEQ ID NO: 409690 - DNA, 564 bp, Homo sapiens
  misc_feature: GZ8MTXP01DH6PY.11.71.G05.1.454.CMB.2.raw
  modified_base (250)..(250): a, c, t, g, unknown or other
  modified_base (268)..(268): a, c, t, g, unknown or other
  modified_base (277)..(277): a, c, t, g, unknown or other
  modified_base (294)..(294): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtggggggaggcgtggtccaggcctggggaggtccctgagactctcctgtacngcctctggcttcaccttnattacctanggcatgcactgggtccncagacctccgaggcgagggggctgggagtgggtggctagtttattcatatgaagtaggaaatgtgtacttactattcagactccgtagaacgggcctattccaccgtctccagacgacactccgagtcacacgctgtactctaggactaaagtcgaaacagaccgtgagaacgctaggacggaccacgggtcttggttgttaattacgtgtgaacgttaaagttatttaataagtaagtagggtagttacggtaacggggttcgttaacg

SEQ ID NO: 409691 - DNA, 512 bp, Homo sapiens
  misc_feature: GZ8MTXP01BBVWM.11.71.G05.1.454.CMB.2.raw
  modified_base (302)..(302): a, c, t, g, unknown or other
  modified_base (469)..(469): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggagcgtggtccagcctgggagtccctgagactctcctgtacagcctctggctcacttcattacctatggcatgcactgggtccnccagactccgaggcagggggctggagtgggtgctagttattcatatgaatggaatgtgacttctattcagtactcgtgaggcattcacgtctccagacgacactccaggccacgacgctgtatctgcaaatcgaacagcctgaagaagcgttggacggacgacggtnttggttgttattctgttgacgtaagttatttcgttaagtaagg

SEQ ID NO: 409692 - DNA, 520 bp, Homo sapiens
  misc_feature: GZ8MTXP01BEKB2.11.71.G05.1.454.CMB.2.raw
  modified_base (267)..(267): a, c, t, g, unknown or other
  modified_base (304)..(304): a, c, t, g, unknown or other
  modified_base (475)..(475): a, c, t, g, unknown or other
  modified_base (490)..(490): a, c, t, g, unknown or other
  modified_base (505)..(505): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctggggagtccctgagactctcctgtacagcctntggctcaccttcattaccatggcatgcactgggtccnccagacctccgaggccgagggggctgggaggtgggtggcagttatttcgatatgaatagggaatggtgtacttctattcagactcgtgaaggcgattcacgtctcagagacaatcagcacgacgtctgatctgacaaagtgaacagcctgagaagcttggaggacgacggnttgttgttattaacnggtgacgtaaagttntttgttaagtaaggg

SEQ ID NO: 409693 - DNA, 523 bp, Homo sapiens
  misc_feature: GZ8MTXP01EEOCD.11.71.G05.1.454.CMB.2.raw
  modified_base (262)..(262): a, c, t, g, unknown or other
  modified_base (301)..(301): a, c, t, g, unknown or other
  modified_base (358)..(358): a, c, t, g, unknown or other
  modified_base (493)..(493): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggagtccctgagactctcctgtacagcctntggcttcaccttcatacctatggcatgcacgtgggtccnccagacctcaggcagggggctggagtgggtgctagttattcatatgatggaaatgtnacttctattcagtactccgtagaacgggccattcacgtctccagagacaattccagcacacgctgtactctgacaaatgaacagcctagagagctggagaacacggctgttgtattacgttgttgacgtaaagtntttaatatagaggtgaacggttaacggggg

SEQ ID NO: 409694 - DNA, 550 bp, Homo sapiens
  misc_feature: GZ8MTXP01CPSAR.11.71.G05.1.454.CMB.2.raw
  modified_base (449)..(449): a, c, t, g, unknown or other
  modified_base (503)..(503): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggaggtccctgagactctcctgtacagcctctggcttcaccttcattacctatggcatgcacgtgggtcccgccagactccgaggcgagggggctgggagtgggtggcagttattcatatgataggaaatagtgtacttactattcagtacctcgtagaacgggcctatccaccgtctaccagagaccaattcccaggccacacgctgtatcgtcggacaaatgaacngcctgagacgctggacggacacggctgttggttattacgttgtgacgaaagttntttcgtaagtggtagggttcggacggtaaccgggggttcgtttaacg

SEQ ID NO: 409695 - DNA, 542 bp, Homo sapiens
  misc_feature: GZ8MTXP01DGSQ4.11.71.G05.1.454.CMB.2.raw
  modified_base (292)..(292): a, c, t, g, unknown or other
  modified_base (354)..(354): a, c, t, g, unknown or other
  modified_base (391)..(391): a, c, t, g, unknown or other
  modified_base (396)..(396): a, c, t, g, unknown or other
  modified_base (499)..(499): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtggggggaggcgtggtccagcctggggagtccctgagactctcctgtacagcctctggcttcaccttcattacctatggcatgcacgtgggtccncagacctccgaggcgagggggctggagtgggtgctagtttattcatatgactaggaaatgtnacttctatcagactcgtagaaggccgattccacgtcncaganacatccaggcacacgctgtatctaggacaaatagaaacagcctgagagcgtgaggaccgaggcttgttagttattacgtggtagacgttaaagttactttaanaagtaaggagggtagttacggttaacgggggttcgtttaacgg

SEQ ID NO: 409696 - DNA, 622 bp, Homo sapiens
  misc_feature: GZ8MTXP01E0O2G.11.71.G05.1.454.CMB.2.raw
  modified_base (291)..(291): a, c, t, g, unknown or other
  modified_base (339)..(339): a, c, t, g, unknown or other
  modified_base (510)..(510): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctcctgtacagcctctggccttcaccttcattacctatggcatgcacgtcggtccnccagacctccgaggcgagggggctgggagtgggtgctagttattcatntgataggaaatgtgtacttctattcagtactccggtaggaacgggccgtaattcccaccgtctaccgaagacgactaacttaccgacggtcaacacgcctagtactccgtaggaactaaagtacgaacacgcctaggacgtaggaccgtaggaacggtaccgaaccgggtnttggttacggttaactttacgtaggtacggttaacgttaaaagttacgttttaacgtaagttaacgggtaagggtacggttaccgggttaaccgggggttccgtttaaccgg

SEQ ID NO: 409697 - DNA, 560 bp, Homo sapiens
  misc_feature: GZ8MTXP01CCJM1.11.71.G05.1.454.CMB.2.raw
  modified_base (246)..(246): a, c, t, g, unknown or other
  modified_base (264)..(264): a, c, t, g, unknown or other
  modified_base (361)..(361): a, c, t, g, unknown or other
  modified_base (489)..(489): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggttttcctcgttgctcttttaagaggtgtccagtgtcaggtgcaactggaggagtcgtggggggagcgtggtccagccgtgggagtccctgagactctcctgtacngcctctggcttcaccttnattacctatggcatgcacgtgggtcccgccagacctccgagggccgaggggggctgggaggtggggtgctagtttattcatatgaataggaaatgtntactttctattcagtaccttcggagaacgggcctatccaccgtctaccagacgacaacttcccaggacacacgctagtactctagggacaaagtcgaacagccagagtacgctaggacgacgacggtntgttgtattcgtgtgaacgttaagttattaacgtagtaagtaggtcgacgggttaacggggttcgtttcgg

SEQ ID NO: 409698 - DNA, 523 bp, Homo sapiens
  misc_feature: GZ8MTXP01BKYAX.11.71.G05.1.454.CMB.2.raw
  modified_base (305)..(305): a, c, t, g, unknown or other
  modified_base (475)..(475): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctcctgtacagcctctggctcaccttcattacctatggcatgcactgggtccnccagactccgaggcgaggggggctgggagtggggtggctaggttattcatatgaatggaatgtgacttctattcagtactcgtgaggcgatcacgtctcagagacatccaggcacgacgctgtactctgacaatagaacagcctgagaagcgttggacgacggggggacncgttgttgttattaacgtgtgacgaagttatttaacgttaagtaaggg

SEQ ID NO: 409699 - DNA, 539 bp, Homo sapiens
  misc_feature: GZ8MTXP01DMTPV.11.71.G05.1.454.CMB.2.raw
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggagtccctgagctctcctgtacagcctctggctcaccttcattacctatggcatgcactcgggtccgccagactccaggcgaggggggctggagtgggtgctagttattcatatgaatggaatgtgtacttctattcagactccgtgaagggccgattccaccgtctccagacgacacttccagcacgacgctgtatctgacaaatacgaacacgcctgagaacgcgttggaaggacgaacgggtcttaggttgttattaactggtaagacgtaaaggttatttaacgttaagtaaggg

SEQ ID NO: 409700 - DNA, 562 bp, Homo sapiens
  misc_feature: GZ8MTXP01EJN6A.11.71.G05.1.454.CMB.2.raw
  modified_base (264)..(264): a, c, t, g, unknown or other
  modified_base (303)..(303): a, c, t, g, unknown or other
  modified_base (462)..(462): a, c, t, g, unknown or other
  modified_base (490)..(490): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggagtccctgagactctcctgtacagcctcnggcttcaccttcatacctatggcatgcacgtgggtcccncagacctcgaggcgagggggctgggagtgggtgctagtttattcatatgataggaaatcgtagtactttctattcagtactccggtaggaaacgggccctattccaccgtctccagagaacaacttccagcacacgctgtactctagacaaatgaaacngcctagagtagctagaggaacacggttntgttagtattacgttgttgacgtaaagtatttaacgtaagtagggttaggtcggttaacggttaaccggggg

SEQ ID NO: 409701 - DNA, 572 bp, Homo sapiens
  misc_feature: GZ8MTXP01B9TKS.11.71.G05.1.454.CMB.2.raw
  modified_base (261)..(261): a, c, t, g, unknown or other
  modified_base (266)..(266): a, c, t, g, unknown or other
  modified_base (304)..(304): a, c, t, g, unknown or other
  modified_base (348)..(348): a, c, t, g, unknown or other
  modified_base (371)..(371): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagcctgggagtccctgagctctcctgtacngcctntggctcacttcattacctatggcatgcacgtcggtccncagctccgaggcgagggggctgggagtgggtggctaggttattnatatgaataggaatgtgtacttntattcgagtaccgtccgtaggacgggtacgtacttccgacccgttctaccgagacgaactaacttaccgagccacgacgtctacgtatctagacaaagtacgaacagcctagagaagcgttagggacggacgtacggtcttaggttcgttagttaacgtggtaacggtaacgtaaagttagtttaacgttaagttaagggg

SEQ ID NO: 409702 - DNA, 622 bp, Homo sapiens
  misc_feature: GZ8MTXP01CP93U.11.71.G05.1.454.CMB.2.raw
  modified_base (265)..(265): a, c, t, g, unknown or other
  modified_base (292)..(292): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggaggtcgtgggggagcgtggtccagcctgggagtccctgagactctcctgtacagcctctggcttcacccttnattacctatgcatgcacgtgggtcccnccagacctccgaggcgagggggctgggagtggggtgctagtttatttcaatagtgaagtaggaaaattgtacgtaactttcgttaattccgaagtaccgtcccgggtaggaacgggtcccgtaattccacccgtctaccaagacgaactaaacgttccaacgggcaaccgaacgctacgtataccgtaggaactaaagtagaaaccaagcccgtaggagaacgctaggaaggtaccgacggtctgttgtagttcgtaggtggaacgttaaagttactttaactaagttaagggaggttacggacgggttaacgggggttctttaaccggg

SEQ ID NO: 409703 - DNA, 532 bp, Homo sapiens
  misc_feature: GZ8MTXP01BSY8P.11.71.G05.1.454.CMB.2.raw
  modified_base (181)..(181): a, c, t, g, unknown or other
  modified_base (308)..(308): a, c, t, g, unknown or other
  modified_base (360)..(360): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcaactggaggagtcgtgggggagcgtggtccagcctggggagtccctgagactctcctgtacagcctctggctcaccttcattacctatggcatgccacgtcgggtccnccagacctccgaggcgagggggctgggagtggggtggctagtttattcatangaatagggaatgtgacttcattcagtactccgtagacggcatcacgtctccagagacatccagcacacgctgtactctgacaaatagaacagccgtagaggaagcttggacggacgacgggcttgttgttacttaatggtaagacgtaaagttatttaacgttaagtaaggg

SEQ ID NO: 409704 - DNA, 582 bp, Homo sapiens
  misc_feature: GZ8MTXP01AWGW8.11.71.G05.1.454.CMB.2.raw
  modified_base (147)..(147): a, c, t, g, unknown or other
  modified_base (246)..(246): a, c, t, g, unknown or other
  modified_base (287)..(287): a, c, t, g, unknown or other
  modified_base (348)..(348): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtgggtttcncgttgctctttaagaggtgtccagtgtcaggtgcaactggaggagtctgggggagcgtggtccagcctgggagtccctgagactctcctgtacagcctntggcttcaccttcattaccatggcatgcactggggtccccncagctcgaggcgagggggctggaggtgggtgctagtttattcatagtgactaggaaatgtntacttactatcagtctcggtaggacgggctattccaccgtctaccgagacgaactaactaccgacgaccacgacgtctacgtactcgtacggaactaaacgtacgaacgacgtacgtacgacgacgcgtacggacggtacggacggtcgtcgttacgttacgttacgtacgtacgttacgttaacgttacgttaatagtaaggtaggtacggttacggtaacgggttcggttcg

SEQ ID NO: 409705 - DNA, 552 bp, Homo sapiens
  misc_feature: GZ8MTXP01E0V3U.11.71.G05.1.454.CMB.2.raw
  modified_base (288)..(288): a, c, t, g, unknown or other
  modified_base (349)..(349): a, c, t, g, unknown or other
  modified_base (391)..(391): a, c, t, g, unknown or other
  modified_base (472)..(472): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggagtccctgagactctcctgtacagcctctggcttcaccttcattacctatggcatgcactgggtccncagactccgaggcgagggggctgggagtggggtgctagttatttcatatgatggaaatgtnacttactattcagtactccgtgaacgggccgattccacgtcncagagacattccaggcacacgctagtatcctgggactaaatgaaacacgaccgtagagagctaggaacggacgaccgggtnttggttagttacttacgtgtacgaacgttaaattacttaagtagtaaggagggtacggttacgggtaacggggttcgttg

SEQ ID NO: 409706 - DNA, 576 bp, Homo sapiens
  misc_feature: GZ8MTXP01BLDNO.11.71.G05.1.454.CMB.2.raw
  modified_base (309)..(309): a, c, t, g, unknown or other
  modified_base (346)..(346): a, c, t, g, unknown or other
  modified_base (444)..(444): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcgtggtttcctcgttgctctttaagaggtgtccagtgtcaggtgcaacgtggaggagtcgtgggggagcgtggtccaggccgtgggaggtccctgagactctcctgtacagcctgtggctcaccttcattacctatggcatgctacgtcgggtccncagacctccgaggccgagggggctagggagtgggggngctaaggtttattcgatagtgaaataggaatgtgtacttgtatcacgtactcgtagaacggtcattcacgtctaccagagacactcgagcacgacgtntgtactctgactaaagacgaaacacggtacctggaagcggacttagggaaaggttaccgaaccggttcgttagttcgttaacttaacggtgtaacggtaacgtaaaaggttatttaacgttaagttaagggg

SEQ ID NO: 409707 - DNA, 547 bp, Homo sapiens
  misc_feature: GZ8MTXP01EAVU8.11.71.G05.1.454.CMB.2.raw
  modified_base (358)..(358): a, c, t, g, unknown or other
  modified_base (418)..(418): a, c, t, g, unknown or other
  modified_base (472)..(472): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagcctgggaggtccctgagactctcctgtacagcctctggcttcaccttcattacctatggcatgcacgtcggtcccgccagacctccgaggcgagggggctgggagtggggtgctagttatttcatatgataggaaatgtntacttctattcagtactccgtagaagggccattccacgtctcagagacatacagcacacnctgtatctagacaaatcgaaacacgcctgagagcgtggaacggacgaccgggtntgttagttattacgtgtacgaagttaaagttatttaatagtaaggtagggtagttacgggtcgggggttcgttcg

SEQ ID NO: 409708 - DNA, 594 bp, Homo sapiens
  misc_feature: GZ8MTXP01DWQ0A.11.71.G05.1.454.CMB.2.raw
  modified_base (247)..(247): a, c, t, g, unknown or other
  modified_base (292)..(292): a, c, t, g, unknown or other
  modified_base (337)..(337): a, c, t, g, unknown or other
  modified_base (545)..(545): a, c, t, g, unknown or other
tcagcgagagataccacgaccggtgctcgatttagtgtcgtcgcaagagagaggagcccagcactagaagtcggcggtgtttccattcggtaatcagcactgaacacagaggactcaccatggagtttgggctgagctgggttttcctcgttgctcttttaagaggtgtccagtgtcaggtgcaacgtggaggagtcgtgggggaggcgtggtccagccgtgggagtccctgagactctcctgtacngcctctggcttcaccttcattacctatggcatgcacgtgggtccnccagacctccgagggcagggggctgggagtgggtgctagttattnatatgataggaaatcgtgtacttctaaattcaaggtacctccggtaggaaacggggtccctaattccaacccgtctacccagacgactaaattccgaaggcaacacgcttagtactactgaccaaaagtcggaaacaggaccctagagacgacgtaggaacggaccgacgggtctggttagttacttacgttgtagtaacgaaagttntttacgtaagaggtaaggtcgacggttacgggggtcttcgtttaaccgg

SEQ ID NO: 409709 - DNA, 612 bp, Homo sapiens
  misc_feature: GZ8MTXP01B5AZ9.11.71.G05.1.454.CMB.2.raw
  modified_base (297)..(297): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagccgtgggagtccctgagactctcctgtacagcctctggcttcaccttcattaccctatggcatgccacgtcgggtcccnccagacctccgaggcgaggggggctgggaggtggggtggctaggtttatttcatatgataggaaattgtgtactttctaattcagtacctccggtaggaaacggggtccctaattcccgacccgttctaccgaagacgactaacttcccgaggccacgacgctagtactctaggactaaaatcgaaacacgcctaggagacgcgtaggacggacgacggtcttggttaggttacttacgtaggtaggaacgttaaaagttctttaacgtaagtaaggtagggtcggttaccgggtaacgggggttcgtttaacgg

SEQ ID NO: 409710 - DNA, 615 bp, Homo sapiens
  misc_feature: GZ8MTXP01BCPQJ.11.71.G05.1.454.CMB.2.raw
  modified_base (248)..(248): a, c, t, g, unknown or other
  modified_base (253)..(253): a, c, t, g, unknown or other
  modified_base (264)..(264): a, c, t, g, unknown or other
  modified_base (272)..(272): a, c, t, g, unknown or other
  modified_base (288)..(288): a, c, t, g, unknown or other
  modified_base (316)..(316): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggtttccgtcgttagctctttaagaggtgtccagtgtcaggtgcaagtggaggagtcgtgggggagcgtggtccaggccgtgggacggtccctgagactctcctgtacngcctntgcttcacttnattaccangcatgcacgtcggccncagacctccgaggcgagggggctggggnggtggtggcgtagttagttactatagtagtagtaggtaaagtagtacgtacttaacttacttctacgtaccgtacgtacggtacggtacgtacttaccgtaccgtacctaccgacgacgaactaacgtaccgacgacacgacgtacgtacgtactactacgaactaaacgtaacgaacgacgtacgtacgacgacgacgtacggacggacgacggtcgtgttagttagttacgtagtacgttacgttaagttacgttaagtagtaaggtacggtacggttacggtaacgggttcgttcg

SEQ ID NO: 409711 - DNA, 542 bp, Homo sapiens
  misc_feature: GZ8MTXP01BG3FG.11.71.G05.1.454.CMB.2.raw
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacagcctctggcttcaccttcattacctatggcatgcactgggtccgccagacctccgaggcgagggggctgggagtggggtgctagttattcgatatgatggaaatgtgtacttcgtattcagtactccgtgaacgggcctattccaccgtctccgagacgactaattccgaggcacacgctgtatctggactaaatcgaacacgcctagagagctaggagcgacgggtctggttgttattacgtgtgacggttaaattatttcagttaagagggtgacgttaacgggggcgtttaacgg

SEQ ID NO: 409712 - DNA, 708 bp, Homo sapiens
  misc_feature: GZ8MTXP01DTJBE.11.71.G05.1.454.CMB.2.raw
  modified_base (159)..(159): a, c, t, g, unknown or other
  modified_base (302)..(302): a, c, t, g, unknown or other
  modified_base (352)..(352): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcgtggttttccncgttgctctttaagaggtgtccagtgtcaggtgcaacgtggaggagtcgtgggggagcgtggtccagcctggggagtccctgagctctcctgtacagcctctggtcttcacccttcatacctatggcatgcacgtgggtcccnccagactccgaggcgagggggctgggagtgggtggctagtttattcatangatggaaatgtaagtactttctaattcgaagtcccgtccgggtaggaaacgggggtccctagtttcccgaacccggttcctacccgaagaacggtaaacctaaacgtttaccccgaacggacctaaaccacggtaccttaggtacttaccgttaggaaccctaaaacgtagaaaccgacggtaccctacggaacgtagggtaccgtaggggaacgggaaccgaacccgggggtttcgtttacggttaacgttaacgtttaacggttacggttaacggttaaacggttaaagtttaacgttttaacgtaaggttacgggttaacggggttaacggttaaccgggggttaaccggggg

SEQ ID NO: 409713 - DNA, 534 bp, Homo sapiens
  misc_feature: GZ8MTXP01DMY8Y.11.71.G05.1.454.CMB.2.raw
  modified_base (306)..(306): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccagccgtgggagtccctgagactctcctgtacagcctctggctcaccttcattacctatggcatgcactggtccnccagactccaggcgagggggctggagtgggtggctagttattcatatgaattggaatagtgacttctattcagtactccgtgaacgggccgattccgaccgtctccagacgacaattccaggcacgacgctagtactctgacaaatacgaacacgcctgaagaagcttagacggacgacggcttagttgttaattctgtcgacgtaaagttattttcgaagttaaggg

SEQ ID NO: 409714 - DNA, 573 bp, Homo sapiens
  misc_feature: GZ8MTXP01EKV71.11.71.G05.1.454.CMB.2.raw
  modified_base (309)..(309): a, c, t, g, unknown or other
  modified_base (356)..(356): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagcctggggagtccctgagactctcctgtacagcctctggctcaccttcattacctatggcatgcacgtcgggccncagacctccgaggccgagggggctgggagtggggtggctagttattnatatgaataggaatgtgtacttctattcgagtacctccggtaggaacgggccgtattccaccgtcctaccagacgacaacttccaggcacgaacgcttagtactctagactaaagtacgaaactacgtcctagagaagcgttaggacggacgacggtcttggttgttacttaacgtggtaacgtaacggtaaagttactttaacgttaagtaacggg

SEQ ID NO: 409715 - DNA, 564 bp, Homo sapiens
  misc_feature: GZ8MTXP01EQF1O.11.71.G05.1.454.CMB.2.raw
  modified_base (276)..(276): a, c, t, g, unknown or other
  modified_base (295)..(295): a, c, t, g, unknown or other
  modified_base (503)..(503): a, c, t, g, unknown or other
  modified_base (520)..(520): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccaggcctgggaggtccctgagactctcctgtacagcctctggcttcaccttcattacctanggcatgcacgtgggtcccncagactccgaggcgagggggctgggagtggggtgctagtttattcatatgataggaaatgtgactttacattcagtacctccgtaggaacgggccgtattcccaccgtctaccgagacgacaattcccaggccacgacgctagtactctaggaacaaatacgaacagcctagagacgcgtagacggacgcggaatgttagtattacgnggtagaagttaaagttntttaatagtaaggaggtaggacggtaacgggggttcttaaccgg

SEQ ID NO: 409716 - DNA, 546 bp, Homo sapiens
  misc_feature: GZ8MTXP01BGYIA.11.71.G05.1.454.CMB.2.raw
  modified_base (311)..(311): a, c, t, g, unknown or other
  modified_base (354)..(354): a, c, t, g, unknown or other
  modified_base (377)..(377): a, c, t, g, unknown or other
  modified_base (497)..(497): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccaggccgtggggacgtccctgagactctcctgtacagcctctggctcaccttcattacctatggcatgcacgtggtccnccagctccgaggcgagggggctggagtgggtgctagttatttnatatgaataggaatgtgtacttntatcagtctcgtgaggtcgacttcaccgtctaccagacgacattcgagtcacgacgcttagtactctagtacaaatagaacaagtcctagagaacgcttaggagcgaacggcttaggttnttacgttaactggtaacgtaaggtaaagttactttcgttaagttaaggg

SEQ ID NO: 409717 - DNA, 652 bp, Homo sapiens
  misc_feature: GZ8MTXP01CL3YR.11.71.G05.1.454.CMB.2.raw
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctcctgtacagcctctggccttcaccttcattacctatggcatgcactgggtcccncagacctccgaggcgaggggggctgggaggtgggggtggctaggtttatttcaattagtggaacgtagggaaaattaggtgtaacctttcttaatttcgaagtacctcccgggtaggaacgggccgtattccgacccgttctacccgaaggacgaacctaaacttcccgagggaccaaccgacgtccttagtactccgttagggaacctaaaagttcgaaaccaggtccccgtaggaagaacggccgtaggacgggaaccacggggtcttggttagttacttacgtggtcgaacggttaaagttacgttttaacaggttaacggagggttgaaccgggttaacgggggttcgttttaacgg

SEQ ID NO: 409718 - DNA, 586 bp, Homo sapiens
  misc_feature: GZ8MTXP01C4RJE.11.71.G05.1.454.CMB.2.raw
  modified_base (247)..(247): a, c, t, g, unknown or other
  modified_base (274)..(274): a, c, t, g, unknown or other
  modified_base (294)..(294): a, c, t, g, unknown or other
  modified_base (357)..(357): a, c, t, g, unknown or other
  modified_base (547)..(547): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtggggggagcgtggtccagcctgggagtccctgagactctcctgtacngcctctggcttcaccttcattacctanggcatgcacgtcgggtcccncagacctccgaggcgagggggctgggaggtgggtgctagtttattcatatgataggaaatgtntactttctattcagtacctccggtaggaacgggccctaattccacccgttctacccgaagacgaacctaacttcccgaaggcacgacgtctgtactcgtaggactaaagtcgaaactagcctaggaagacgcgtaggaacggacgacggcttgttagttattacgtggagaacgttaaagttactttaanaagtaaggtagggtacgacggttcgggggttctttaacg

SEQ ID NO: 409719 - DNA, 537 bp, Homo sapiens
  misc_feature: GZ8MTXP01EEJBM.11.71.G05.1.454.CMB.2.raw
  modified_base (292)..(292): a, c, t, g, unknown or other
  modified_base (494)..(494): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccaggcctggggagtccctgagactctcctgtacagcctctggcttcaccttcattacctatggcatgcactgggtcccnccagactcccgaggcgagggggctggagtgggtgcagtttattcatatgataggaaatgtgactttctattcagtactccggtgaacgggccgtattccaccgtctccagagacaattcaggcacacgctgtatctggacaaatgaacagcctgagagctggacggacgacggctgttgttattacgtgtagacgaaagttntttctaagtaaggtaggtaggacggtaacgggggcgtttaacg

SEQ ID NO: 409720 - DNA, 557 bp, Homo sapiens
  misc_feature: GZ8MTXP01EWP06.11.71.G05.1.454.CMB.2.raw
  modified_base (245)..(245): a, c, t, g, unknown or other
  modified_base (291)..(291): a, c, t, g, unknown or other
  modified_base (357)..(357): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggaggtccctgagactctcctgtacngcctctggcttcaccttcattacctatggcatgcacgtgggtcccncagacctccgaggcgagggggctgggagtgggtgctagttattcatatgataggaaatgtgacttntattcagtactccggtagaacgggtcctattccaccgtctaccagagacaattccagcacacgctgtactctaggactaaatacgaacagccgtagagagctaggacggaacgacggtgtgttagtactttacgtggtagacgttaaagttactttaagtagtaaggtaggtagacgggtaacgggggttccgtttaagg

SEQ ID NO: 409721 - DNA, 540 bp, Homo sapiens
  misc_feature: GZ8MTXP01DVNP9.11.71.G05.1.454.CMB.2.raw
  modified_base (307)..(307): a, c, t, g, unknown or other
  modified_base (340)..(340): a, c, t, g, unknown or other
  modified_base (348)..(348): a, c, t, g, unknown or other
  modified_base (467)..(467): a, c, t, g, unknown or other
  modified_base (498)..(498): a, c, t, g, unknown or other
tcagcgagagataccacgaccggtgctcgatttagtgtcgtcgcaagagagaggggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggagcgtggtccagccgtgggagtccctgagctctcctgtacagcctctggctcaccttcattacctatggcatgcacgtggtccnccagactccgaggccgagggggctgggagtggngctagttnttcatagtgaaagtaggaatgtgtactttctattcagtactccgtagacggcgtatcgactctcagagactaactccagtccacgcgtctgtactactgacaaatacgaactagctagngaactcgttagacggacgtacggcttggttnttactaacgtagtcgtaacgaaggttactttgaagtaacggg

SEQ ID NO: 409722 - DNA, 547 bp, Homo sapiens
  misc_feature: GZ8MTXP01DV8WR.11.71.G05.1.454.CMB.2.raw
  modified_base (267)..(267): a, c, t, g, unknown or other
  modified_base (305)..(305): a, c, t, g, unknown or other
  modified_base (338)..(338): a, c, t, g, unknown or other
  modified_base (346)..(346): a, c, t, g, unknown or other
  modified_base (371)..(371): a, c, t, g, unknown or other
tcagcgagagataccacgaccggtgctcgatttagtgtcgtcgcaagagagaggggggagctctgggagaggagcccagcactagaagtcggcggtgtttccattcggtgatcagcactgaacacagaggactcaccatggagtttgggctgagcgtgggtttcctcgttgctctttaagaggtgtccagtgtcaggtgcaacgtggaggagtcgtgggggagcgtggtccagccgtgggagtccctgagctctcctgtatagcctntggctcaccttcattacctatggcatgcacgtggtccnccaagctccgaggcgagggggctggagtggggngctagttnttcatatgaatgaagtgtgtacttntattcagctcgtagaggccgattcacgtctacagagacactccagcacgacgtcttagtactctgacaaagtacgaaactacggcctaggagtaacgtgcgggaaggacgaaccggtgttaggttgttacgtttaacgtagtcgaagtaaaggttatttaaccgttaagttaaggg

SEQ ID NO: 409723 - DNA, 576 bp, Homo sapiens
  misc_feature: GZ8MTXP01DB28P.11.71.G05.1.454.CMB.2.raw
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccaggcctggggagtccctgagactctcctgtacagcctctggcttcaccttcattacctatggcatgcacgtggtccgcagactccgaggcgagggggctgggagtgggtgcagtttattcatatgatggaaatgtgacttctattcgagtactccggtaggaacgggccgaattcaccgtctccagacgacaattccagcacacgctgtatctggacaaatacgaacagccgtagagaacgcgtaggaacgggacgacgggtaacgtggttcggttaattacgttggtgttaacggttaaaggttattttaacgaagttaaggtagggtacggttacgggttaacgggggttcgtttaaccg

SEQ ID NO: 409724 - DNA, 560 bp, Homo sapiens
  misc_feature: GZ8MTXP01ECCXZ.11.71.G05.1.454.CMB.2.raw
  modified_base (338)..(338): a, c, t, g, unknown or other
  modified_base (408)..(408): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagcctgggagtccctgagactctcctgtacagcctctggctcaccttcattaccatggcatgcacgtgggtccgccagactccgaggccgagggggctggagtgggngctagttatttgatatgaataggaattcgtgtacttctattcagtactcgtagaaggccgattcacgtcncagagacaactcagcacgacgctgtatcgtgactaaatagaaacagcctaggagaacgcgttaggaacgggaccgaacgggtcgttagttgttaagtttaacgtaggtaaggtaaccggtaaaagttacctttttaacgaagtttaaggggg

SEQ ID NO: 409725 - DNA, 575 bp, Homo sapiens
  misc_feature: GZ8MTXP01B4MVK.11.71.G05.1.454.CMB.2.raw
  modified_base (245)..(245): a, c, t, g, unknown or other
  modified_base (291)..(291): a, c, t, g, unknown or other
  modified_base (360)..(360): a, c, t, g, unknown or other
  modified_base (398)..(398): a, c, t, g, unknown or other
  modified_base (450)..(450): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctcctgtacngcctctggcttcaccttcattaccctatggcatgcacgtgggtccnccagacctccgaggcgagggggctgggaggtggggtgctagtttattcatatgatggaaatgtgacttntattcagtcctcggtagacgggccgtattccaccgtcnccagacgacaatccgaggcacacgctgtactctggaaccaaagtagaaaccngaccgtgacgacgctaggacggacgcggtctgttggtaatttcgtggtagttaacggttaaagttacttttaagtaagttaacggaagggtcggttaaccgggttaacgggggttcgtttaacgg

SEQ ID NO: 409726 - DNA, 649 bp, Homo sapiens
  misc_feature: GZ8MTXP01ED8MI.11.71.G05.1.454.CMB.2.raw
  modified_base (251)..(251): a, c, t, g, unknown or other
  modified_base (298)..(298): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggaggcgtggtccaggccgtgggacgtccctgagactctcctgtacngcctctggcttcaccttcattacctatggcatgcacgtcgggtcccnccagacctccgaggcggagggggctgggaggtgggtgctagtttattcatagtgagtaggaaatgtgtacttactattcgagtaccgtccggtaggaacgggtcctattcccgaccgtctaccgaaggaacgtaacctaaacgttacccgaacgggacctaaccgacggtccttaggttactccgttaggggaacctaaagtacgaaactacgccgtaggagacgcgtaggaacggaccgacgggtcttggttagttacgttaccgtggtaaccgaaagttaaagttactttaacgtaagtaagggtacgggtacggttaccggggttaaccgggggttcgttttaaccgg

SEQ ID NO: 409727 - DNA, 560 bp, Homo sapiens
  misc_feature: GZ8MTXP01CD3K5.11.71.G05.1.454.CMB.2.raw
  modified_base (293)..(293): a, c, t, g, unknown or other
  modified_base (326)..(326): a, c, t, g, unknown or other
  modified_base (356)..(356): a, c, t, g, unknown or other
  modified_base (392)..(392): a, c, t, g, unknown or other
  modified_base (550)..(550): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggagtccctgagactctcctgtacagcctctggcttcaccttcattacctatggcatgcacgtcggcccncagcctccgaggcgagggggctgggagtggggngctagtttattcatatgaataggaaatgtntacttatattcagtactcgtagacggcatccacgtntcagagacatcagcacgacgctgtatctaggacaaagtcgaaacagccgtagagacgcgtaggacggaccgacggtctggttagttaacgttcgtaggtgttaacggttaaagttactttaagtagtaagggtaggtacggacgggttccgggggttntttaaccggg

SEQ ID NO: 409728 - DNA, 559 bp, Homo sapiens
  misc_feature: GZ8MTXP01DEAAZ.11.71.G05.1.454.CMB.2.raw
  modified_base (302)..(302): a, c, t, g, unknown or other
  modified_base (336)..(336): a, c, t, g, unknown or other
  modified_base (365)..(365): a, c, t, g, unknown or other
  modified_base (371)..(371): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggagtccctgagctctcctgtacagcctctggcttcaccttcatacctatggcatgcacgtgggtcccnccagactccgaggcgagggggctggaggttgggnggctagtttattcatatgatggaaatgtntacttntatcagactcgagaacgggccattcaccgtctccagacactacttccaggcacacgtctagtatctagaccaaagtcgaacagccgtagagtagcgtaggacggaactacggcttagttgttaagttcgttagttcgaacgtaaagtatttcgtaagtaggttacgggttcgaaccggttaacggggg

SEQ ID NO: 409729 - DNA, 658 bp, Homo sapiens
  misc_feature: GZ8MTXP01BPW47.11.71.G05.1.454.CMB.2.raw
  modified_base (301)..(301): a, c, t, g, unknown or other
  modified_base (367)..(367): a, c, t, g, unknown or other
  modified_base (373)..(373): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtggggggaggcgtggtccaggccgtgggacggtccctgagactctcctgtacagcctctggcttcaccttcattaccctatggcatgcacgtcgggtcccnccagacctccgaggcgagggggctgggaggtggggtgctaggtttattcatatgataggaaatgtntacttntattcgagtaccgtccggtagaacgggtcctattccaccgtctaccagacgactaacttacccgaggaccacgacgtctagtactccgtaggaactaaagtacgaaaccgtacgcccttaggaagacgtcgtacggaacggaccgtacgggtaacttggttacggtttaacttaccggttaggtaacggttaaccggttaaaagttacgttttaaccgtaaggttaagggtacggggttacgggttaaacccggggttaaccgggggttaacgttttaacccggg

SEQ ID NO: 409730 - DNA, 582 bp, Homo sapiens
  misc_feature: GZ8MTXP01AFQCQ.11.71.G05.1.454.CMB.2.raw
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggttttcctcgttgctcttttaagaggtgtccagtgtcaggtgcaacgtggaggagtcgtgggggagcgtggtccagccgtgggaggtccctgagactctcctgtacagcctctggcttcaccttcattacctatggcatgcacgtcggccncagacctccgaggcgagggggctgggaggtgggtgctagtttattcgattagtagtaacgtaggaaattgtcgtactttactattcgagtacctcgtaggaacgggctattccaccgtctaccagacactactaccgagtcacgacgctagtatcgtaggaacaaagtcgaacacgccgtgaagagcgtaggaacggacgacggtcgtagttggttacttacggtgtagacgttaagttattaagtaagtaaggtagggtacggacgggttaaccggggttcgtttaacgg

SEQ ID NO: 409731 - DNA, 623 bp, Homo sapiens
  misc_feature: GZ8MTXP01DVTJD.11.71.G05.1.454.CMB.2.raw
  modified_base (485)..(485): a, c, t, g, unknown or other
  modified_base (512)..(512): a, c, t, g, unknown or other
  modified_base (514)..(514): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggttgtccagttgtcaggtgcaagtggaggaggtcggtgggggagggcgtggtccgagccgtgggaggtcctgagactctcctgtacacgcctctcggtcttctaccttctattacctatggcatgccacgtcgggtccgcccagacctccgacggcggacggggggctgggaggtggggtgggtactaggtttatttacatagtgaactaggaaattagtgtactttacttattcgagtaccttccgtagggaaacgggccgtacttaccgacccgttctacccaagtacgaactaactttaccgaacggcaacaccncgtgtaatctagggacaaaatgaaacncnccgtgagagtcaggagacgacgtcgttgttgttacttagtgttaggaaccgaaaggttattttcgaagtaagggtaggtggttaccggttaacggggttcgttttaacg

SEQ ID NO: 409732 - DNA, 555 bp, Homo sapiens
  misc_feature: GZ8MTXP01DK9LG.11.71.G05.1.454.CMB.2.raw
  modified_base (266)..(266): a, c, t, g, unknown or other
  modified_base (308)..(308): a, c, t, g, unknown or other
  modified_base (348)..(348): a, c, t, g, unknown or other
tcagcgagagataccacgaccggtgctcgatttagtgtcgtcgcaagagagaggggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtgggaggagtcgtgggggagcgtggtccagcctggggagtccctgagactctcctgtacngcctctggctcaccttcattaccatggcatgcacgtggtccncagctccgaggcgagggggctgggagtgggtgctagtttnttcatatgaataggaatgtgtacttctattcagtacctccgtagaacgggccgtattccaccgtactaccagacgacaacttccgagtccacgcgtctgtaactctagacaaagtcgaacacgacctaggagaagtcgttaggacggacgacggtcttagttgttagttaacgtgtaagaacgtaaagttatttaacgaagtaaggg

SEQ ID NO: 409733 - DNA, 596 bp, Homo sapiens
  misc_feature: GZ8MTXP01EPP3G.11.71.G05.1.454.CMB.2.raw
  modified_base (248)..(248): a, c, t, g, unknown or other
  modified_base (253)..(253): a, c, t, g, unknown or other
  modified_base (294)..(294): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggtttttcctcgttgcttcttttaagaggtgtccagtgtcaggtgcaactggaggagtcgtgggggagcgtggtccagccgtgggagtccctgagactctcctgtacngcctntggcttcaccttcattacctatggcatgcacgtgggtcccncagctccgaggcgagggggctgggagtgggtgctagtttattcatagtgataggaaatgtgtacttctattcagtacctccgtagaacgggcctattccgaccgtctccagacgactacttccacggcacgacgctagtactcgtaggactaaagtacgaaacgacgtcccgtaggacgacggtccgtaggaacgggtaccacgggtcgttgttacgttaattacgtaggtacgacgttaaagttactttaacgtagtaaggtagggtggttaaccgggttaacgggggttcgtttaaccgg

SEQ ID NO: 409734 - DNA, 527 bp, Homo sapiens
  misc_feature: GZ8MTXP01ARGT5.11.71.G05.1.454.CMB.2.raw
  modified_base (262)..(262): a, c, t, g, unknown or other
  modified_base (267)..(267): a, c, t, g, unknown or other
  modified_base (304)..(304): a, c, t, g, unknown or other
  modified_base (364)..(364): a, c, t, g, unknown or other
  modified_base (369)..(369): a, c, t, g, unknown or other
  modified_base (427)..(427): a, c, t, g, unknown or other
  modified_base (439)..(439): a, c, t, g, unknown or other
  modified_base (480)..(480): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggagtccctgagactctcctgtacngcctntgctcaccttcattacctatggcatgcacgtggtccncagactccgaggcgagggggctggagtggggtgctagttattcatatgaataggaatgtnacttntattcagctcgtagacggcatcacgtctcagacgacatccagcacgcgtctgtactcngacaatagaacncgcctagagaacgcttaggacggacgtacggtcttaggttnttaacgttcgtaggttgaacgtaaagttctttaacgttaagtaaggg

SEQ ID NO: 409735 - DNA, 527 bp, Homo sapiens
  misc_feature: GZ8MTXP01B2K11.11.71.G05.1.454.CMB.2.raw
  modified_base (309)..(309): a, c, t, g, unknown or other
  modified_base (369)..(369): a, c, t, g, unknown or other
  modified_base (481)..(481): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggagtccctgagctctcctgtacagcctctggctcaccttcacttacctatggcatgcacgtcggtccncagactccgaggcgagggggctggagtgggtgctagtttattcatatgaataggaatgtnacttctattcagactcgtagaacggcgattccacgtctcagagacatccagtcacgacgctgactctgacaaatcgaaactgcctagagaagcgttaggacggacgacggtnttagttcttagttcgtgtgacgtaagttactttaagttaagtaagg

SEQ ID NO: 409736 - DNA, 557 bp, Homo sapiens
  misc_feature: GZ8MTXP01E0XL7.11.71.G05.1.454.CMB.2.raw
  modified_base (245)..(245): a, c, t, g, unknown or other
  modified_base (250)..(250): a, c, t, g, unknown or other
  modified_base (291)..(291): a, c, t, g, unknown or other
  modified_base (446)..(446): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggaggtccctgagactctcctgtacngcctntggcttcaccttcattacctatggcatgcacgtgggtcccnccagacctccgaggcgaggggggctgggagtgggtgctagttatttcatatgactggaaatgtgacttctattcagactccgtgacgggtccattccaccgtctccgagagacattcccgaggccacgacgctgtactctggacaaatgaaaccncgcctagacgagcgtaggacggacgcggtcttgttagtattacgtgtagaacgttaaagttacttaagtaagtaacggagggtcggttacgggtaaccgggggttcgttcg

SEQ ID NO: 409737 - DNA, 553 bp, Homo sapiens
  misc_feature: GZ8MTXP01EA7UZ.11.71.G05.1.454.CMB.2.raw
  modified_base (181)..(181): a, c, t, g, unknown or other
  modified_base (305)..(305): a, c, t, g, unknown or other
  modified_base (351)..(351): a, c, t, g, unknown or other
  modified_base (373)..(373): a, c, t, g, unknown or other
  modified_base (387)..(387): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcaactggaggagtcgtgggggagcgtggtccagccgtgggagtccctgagactctcctgtacagcctctggctcaccttcattacctatggcatgcacgtggtccnccagacctccgaggcgagggggctgggagtggggtgctagttattnatatgaatggaatgtgtacttntattcagtactcgngaacgggccattccaccgttctccagacgacaactccgagccacgacgtctgtactctgacaaatacgaactgacctgacgaagcgttggaacggacaacgggtcttaggttcgttagtttaacgtggtaacgtacggtaaagttattttaacgttaagttaaggg

SEQ ID NO: 409738 - DNA, 535 bp, Homo sapiens
  misc_feature: GZ8MTXP01EF2WV.11.71.G05.1.454.CMB.2.raw
  modified_base (305)..(305): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctggggagtccctgagactctcctgtacagcctctggctcaccttcattacctatggcatgcacgtggtccnccagactccaggccgaggggggctgggagtggggtgctagttattcatatgaatggaatgtgacttctattcagactcgtgagggcatcacgtctcagagacactcaggcacgacgctagtactctgacaaatcgaaacagcctgagaagcttaggacggacgaacggtcgttggttgttaagttaacgtggtaagtaacgtaaaagttagtttaacttaagttaagggg

SEQ ID NO: 409739 - DNA, 574 bp, Homo sapiens
  misc_feature: GZ8MTXP01DDHSN.11.71.G05.1.454.CMB.2.raw
  modified_base (271)..(271): a, c, t, g, unknown or other
  modified_base (313)..(313): a, c, t, g, unknown or other
  modified_base (509)..(509): a, c, t, g, unknown or other
  modified_base (530)..(530): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggagtccctgacgactctcctgtacagcctntggctcaccttcattacctatggcatcgcacgtcgggtcccnccagactccgagggcgaggggggctggggagtgggggtgctaagtttactttcgattagtgaaagttagggaaatgtgtaactttctaagttcaggtacctccgtagaacgggtccgattccaccgtactaccaagacaactaaacgttccaaacggccaacgaacgtcttagacttcagacaaatagaactagcngagaagcaggacgacgacggngttgttgttataatagtaagacgaagttattaagttaattaagg

SEQ ID NO: 409740 - DNA, 556 bp, Homo sapiens
  misc_feature: GZ8MTXP01DPNLV.11.71.G05.1.454.CMB.2.raw
  modified_base (311)..(311): a, c, t, g, unknown or other
  modified_base (382)..(382): a, c, t, g, unknown or other
  modified_base (456)..(456): a, c, t, g, unknown or other
  modified_base (513)..(513): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggagtccctgagactctcctgtacagcctctggctcaccttcattacctatggcatgcacgtcgggtcccnccagacctcgagggcgaggggggctgggagtggggtgctagttattcatatgaattaggaatgtgtacttntattcagacctcgtagaacgggccattccaccgtctaccagacgacactccaggccacgacgtctacgtactcngacaaagtacgaaacagcctagagaacgtcgttaggacggacgacgggtcttggttnttagttcgtgtaacgagtaaagttactttaagttaagtaaggg

SEQ ID NO: 409741 - DNA, 575 bp, Homo sapiens
  misc_feature: GZ8MTXP01BX396.11.71.G05.1.454.CMB.2.raw
  modified_base (291)..(291): a, c, t, g, unknown or other
  modified_base (360)..(360): a, c, t, g, unknown or other
  modified_base (397)..(397): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacagcctctggcttcaccttcattacctatggcatcgcacgtgggtcccnccagacctccaggcgagggggctgggagtggggtgctagttattcatagtgataggaaatgtgtacttntattcagtactccgtaggacgggtccattccaccgtntccagacgacaattccaggtcacacgctagtatctaggacaaagtcgaaacacgtcccgtaggaacgacgtcgtagggaacggaccgacggtcgtagttggtaacttcgtaggtagacgttaaagttactttaacgagtaacggtgggtacggacgggtaacggggttcgtttaacgg

SEQ ID NO: 409742 - DNA, 533 bp, Homo sapiens
  misc_feature: GZ8MTXP01EXK0A.11.71.G05.1.454.CMB.2.raw
  modified_base (306)..(306): a, c, t, g, unknown or other
  modified_base (410)..(410): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggagcgtggtccagcctgggagtccctgagactctcctgtacagcctctggctcaccttcattacctatggcatgcacgtcggtccnccagactccgaggcgagggggctggagtggggtgctagtttatttcatatgaataggaatgtgtacttctattcagtactcgtgaggcattcaccgtctcaganacaatcagcacgacgctgtactctgacaaatgaacagcctagagaaggcttaggacggacgacgggtacttggttgttagtttaactggtgtacgtaaaggttactttaacgttaagtaaggg

SEQ ID NO: 409743 - DNA, 646 bp, Homo sapiens
  misc_feature: GZ8MTXP01D5WP9.11.71.G05.1.454.CMB.2.raw
  modified_base (195)..(195): a, c, t, g, unknown or other
  modified_base (206)..(206): a, c, t, g, unknown or other
tcagcgagagataccacgaccggtgctcgatttagtgtcgtcgcaagagagaggggagctctgggagaggagcccagcactagaagtcggcggtgtttccattcggtgatcagcactgaacacagaggactcaccatggagtttgggctgagcgtggtttcgcgtagcgtcttaagaggtgtcagtgtcaggtgnaacgtggaggngtcgtggggaggcgtggtcgagccgtggaggtcctgacgctctctcgtacgcgctcgtcgtctctacctactactactacgtcgctatgtcgtcgtcggtccgccgacgtacgtcgcggtacggacgggtcggtggtaggtgggtggtacgtacgttattagtagtagtagtaagtagtaagtagtacgtacttactactacgtacgtacgtacgtacgtacggtacgtacgtacgtaccgtacgtacgacgtaacgaactaacgtacgtacgtacgacggtacgtacgttacgttacgtacgtacgtaacgtaaacgtaacgtaacgtaacgtacgtacggaaggaacgtacgttacggtacggaacggtacggtacgttacgttacgttacgttaacgtacgtaacgtaacgtaacgttacgttaacgttaagtaagg

SEQ ID NO: 409744 - DNA, 699 bp, Homo sapiens
  misc_feature: GZ8MTXP01C7OA3.11.71.G05.1.454.CMB.2.raw
  modified_base (263)..(263): a, c, t, g, unknown or other
  modified_base (272)..(272): a, c, t, g, unknown or other
  modified_base (292)..(292): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctctttaagaggtgtccagtgtcaggtgcaacgtggaggagtcgtggggggagcgtggtccagcctgggagtccctgagactctcctgtacagcctctggcttcaccttnattacctanggcatgcacgtcgggtcccncagacctccgaggcgagggggctggagtgggtgcagtttattcatatgaagtaggtaaatgtgtacttactaattcgagtaccgttccggtaggaacgggtcctatcccgtaccgtcgtaccaaggacgtaacctaacgttaccgaacggtaccaaccgtacggtcgttacgttaacgtccgtacggggaaccctaaaagttaccgaaaccgtacggtacccgttaggaacggtacggtaccgttaagggaacggtaccgtaaccggggttcgttacgggttaacggtttaacgttaaccgttggtaacgggttaaccgttaaaaggttacgttttaaccggtaaagttaacggggtaacggggttacggttaaccggggttaaccggggggttcgttttaaccggg

SEQ ID NO: 409745 - DNA, 609 bp, Homo sapiens
  misc_feature: GZ8MTXP01BJ9RG.11.71.G05.1.454.CMB.2.raw
  modified_base (246)..(246): a, c, t, g, unknown or other
  modified_base (251)..(251): a, c, t, g, unknown or other
  modified_base (294)..(294): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggagtccctgagactctcctgtacngcctntggcttcacccttcattacctatggcatgcacgtcgggtcccnccagcctccgaggcgaggggggctgggaggtgggtggctagtttatttcatatgatggaaatgtgtacttctattcagacctccgtagaacgggccgtattcccgacccgtctacccgagacgaacctaacgttacccgaggtccacgaccgtcttgtaatcgtacgggaactaaagtacgaaacagccctggagaacgtcgtaggaacgggaccgaacgggccttggttagttacttacgtagtacgaacggttaaagttacgtttcaagttaaggtaggtagttaccgggttaacgggggttcgtttaaccgg

SEQ ID NO: 409746 - DNA, 700 bp, Homo sapiens
  misc_feature: GZ8MTXP01D8YFK.11.71.G05.1.454.CMB.2.raw
  modified_base (294)..(294): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagccgtgggagtccctgagactctctgtacagcctctggtccttcaccttcattaccatggcatgcacgtcggtcccncagacctccgaggcgagggggctgggaggtgggtgctagtttatttcatatgaactaggtaaaatgtactactttacgtaactttcgaacgtaaccgtcccgggtagggaaaaccggggtccccgtaatttccccacccgttacctacccgaagaacgtaaaccgtaactttacccgaacggaccaaccgacggtacctaagttactaccttagggaaactaaacgttacgaaaccgacggtacccgtaggaacggaacggtccgtagggaaacggaaccgtaccggggttcttaagggttaccgtttaagtttaaccgtaggtacgttaacggttaaaagttacgtttaacgtaaagtaaggtaagggtcggttaacggggttaacgggggttcgtttaaccggg

SEQ ID NO: 409747 - DNA, 554 bp, Homo sapiens
  misc_feature: GZ8MTXP01CBFUJ.11.71.G05.1.454.CMB.2.raw
  modified_base (264)..(264): a, c, t, g, unknown or other
  modified_base (288)..(288): a, c, t, g, unknown or other
  modified_base (382)..(382): a, c, t, g, unknown or other
  modified_base (411)..(411): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggagcgtggtccagccgtgggacgtccctgagactctcctgacngcctctggctcacttcattacctntggcatgccacgtcggtcccgccagacctcgaggcgagggggctgggagtggggtgctagtttattcatagtgaaagttaggaatgtagacttntattcagtctcgtgacggctatcacgtcncagacacactcagcacgacgtctgtactctagacaaatacgaactacgcctagagaagccgttaggaacggaccgtaacgggtcttaggttgttacttaacgtggtaaggtaacgaaagttactttaacgttaagttaagggg

SEQ ID NO: 409748 - DNA, 592 bp, Homo sapiens
  misc_feature: GZ8MTXP01C1MZW.11.71.G05.1.454.CMB.2.raw
  modified_base (266)..(266): a, c, t, g, unknown or other
  modified_base (308)..(308): a, c, t, g, unknown or other
  modified_base (344)..(344): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagtcttgggttttcctcgttgcttcttttaagaggtgtccagtgtcaggtgcaacgtggaggagtcgtgggggagcgtggtccagccgtgggagtccctgagactctcctgtacngcctctgctcacttcattacctatggcatgcacgtcggtccnccagacctccgaggcgagggggctgggaggtggggnggctagtttattcatatgaaagttaggaattagtgtaactttctattcaagtcctaccgtagaacgggccgtattccgacccgtactaccgtaagaacgaacaacgttccgaaggccacgaaccgtctgtaactctagacaaagtacgaacagacctgaagaagcgttaggacggacgtacgggtcgttagttgttacgttaacgtggtaacgtaacggtaaagttacgttttaacgaagttaagggg

SEQ ID NO: 409749 - DNA, 519 bp, Homo sapiens
  misc_feature: GZ8MTXP01BIIUM.11.71.G05.1.454.CMB.2.raw
  modified_base (245)..(245): a, c, t, g, unknown or other
  modified_base (289)..(289): a, c, t, g, unknown or other
  modified_base (355)..(355): a, c, t, g, unknown or other
  modified_base (467)..(467): a, c, t, g, unknown or other
  modified_base (483)..(483): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacngcctctggcttcaccttcattacctatggcatgcactgggtccnccagactccaggcaggggggctgggagtgggtggcaggttatttcatatgatggaaatgtgacttntattcagactccgtgagggccgattccaccgtctccagacgacaattccaggcacacgctgtatctggcaaatgaacagcctgagagctggagcacggctgttgtattacgngtgacgttaagatttnagtaaggagggtgacggtaacgggggttcgtttcgg

SEQ ID NO: 409750 - DNA, 601 bp, Homo sapiens
  misc_feature: GZ8MTXP01D1LPT.11.71.G05.1.454.CMB.2.raw
  modified_base (246)..(246): a, c, t, g, unknown or other
  modified_base (262)..(262): a, c, t, g, unknown or other
  modified_base (270)..(270): a, c, t, g, unknown or other
  modified_base (289)..(289): a, c, t, g, unknown or other
  modified_base (519)..(519): a, c, t, g, unknown or other
  modified_base (534)..(534): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagccgtgggagtccctgagactctcctgtacngcctctgctcaccttnatacctanggcatgcacgtcgggtccnccagacctccgaggcgagggggctgggagtggggtgctaggtttatttcgaatatagtaagtaggtaaaattggtcgtacctttaccttaattccgaagtacccgttaccgggtacggaaacggggtcccctaagtttaccctacccggttcctacccgaagacgaactaacttacccgaggaccacacgctagtactctagggaacaaagtagaaccagcctagagagngtggagacgacggtntgttagtattagtgtagagttattacttaatagtaaggtaggtacggttacggtaacgggttcgttg

SEQ ID NO: 409751 - DNA, 542 bp, Homo sapiens
  misc_feature: GZ8MTXP01BDFRM.11.71.G05.1.454.CMB.2.raw
  modified_base (356)..(356): a, c, t, g, unknown or other
  modified_base (472)..(472): a, c, t, g, unknown or other
  modified_base (478)..(478): a, c, t, g, unknown or other
  modified_base (505)..(505): a, c, t, g, unknown or other
  modified_base (510)..(510): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggaggtccctgagactctcctgtacagcctctggccttcaccttcattaccctatggcatgcactgggtccgccagactccaggcgagggggctgggagtgggtggctagttattcatatgatggaaatgtgacttntattcagacctccggtagaacggggtccaattccacccgtctaccagacgactaacttccgaggcacgacgctgtactctggacaaatcgaaacacgccagagacgctggaggacncgggtntgttagtacttgtgtgacgttaagttnttaanagtaacggaggtcgacggtcggggttcgttcg

SEQ ID NO: 409752 - DNA, 521 bp, Homo sapiens
  misc_feature: GZ8MTXP01ELEKK.11.71.G05.1.454.CMB.2.raw
  modified_base (306)..(306): a, c, t, g, unknown or other
  modified_base (490)..(490): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagccgtgggagtccctgagactctcctgtacagcctctggctcaccttcattacctatggcatgcacgtggtccnccagactccgaggccgagggggctggagtggggtgctagttattcatatgaataggaatgtgacttctattcagactcgtgaacggcattcacgtctcagacgacactcagacacgacgctgtatctgacaaatagaacagcctgagaagcgttggacggacgacggtacttgttgttacgttntagtgagaaagttatttaacttaagtaaggg

SEQ ID NO: 409753 - DNA, 556 bp, Homo sapiens
  misc_feature: GZ8MTXP01CXIIJ.11.71.G05.1.454.CMB.2.raw
  modified_base (247)..(247): a, c, t, g, unknown or other
  modified_base (252)..(252): a, c, t, g, unknown or other
  modified_base (265)..(265): a, c, t, g, unknown or other
  modified_base (293)..(293): a, c, t, g, unknown or other
  modified_base (342)..(342): a, c, t, g, unknown or other
  modified_base (509)..(509): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccagccgtgggagtccctgagactctcctgtacngcctntggcttcaccttnattacctatggcatgcacgtgggtcccncagacctccgaggcgagggggctgggagtggggtgcagtttattcgatntgactggaaatgtgacttctattcagtactccgtagaacgggcctattccaccgtctaccagagacaattccaggcacacgctgtatctggacaaagtcgaacagccgtgagacgcgtaggaggacgcggtcgtgttgttaattcgttaggtcgaacgttaaagttntttaactagtaaggtagggtgaccggttaacgggggttccgtttaag

SEQ ID NO: 409754 - DNA, 555 bp, Homo sapiens
  misc_feature: GZ8MTXP01EIN6G.11.71.G05.1.454.CMB.2.raw
  modified_base (312)..(312): a, c, t, g, unknown or other
  modified_base (354)..(354): a, c, t, g, unknown or other
  modified_base (371)..(371): a, c, t, g, unknown or other
tcagcgagagataccacgaccggtgctcgatttagtgtcgtcgcaagagagaggggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcggtgggggagcgtggtccagccgtggggacgtccctgagactctcctgtacagcctctggctcaccttcattacctatcggcatgcacgtggtcccnccagactccagtcgagggggctggagtgggtgctagttattnatatgaataggaatgtntacttctatcagtctcgtgacggcgatcacgtcacagagacatccagccacgacgtctgtactctgactaaatacggaaacagcctaggagtaacgacgttggaacggaccgaacgggtcttaggttcgttagttaaccgtggtaaggtaaccgtaaaggttacttttaacgttaagttaaggg

SEQ ID NO: 409755 - DNA, 572 bp, Homo sapiens
  misc_feature: GZ8MTXP01C5BLI.11.71.G05.1.454.CMB.2.raw
  modified_base (310)..(310): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggagtccctgagctctcctgtacagcctctggctcaccttcattacctatggcatgcacgtcgggtcccnccagacctccgaggccgagggggctgggagtggggtgctagtttattcatatgaataggaatgtgtacttcattcagactccgtagaacgggcctattccaccgtctaccagacgaacaatccgaaggccaacgacgcttagtactctagaacaaagtacgaaacacgcctaggagaacgcgttagggacggacgacgggtcttaggttgttaactttaacgtaggtaacgtaacgtaaagttatttaacgttaagtaaggg

SEQ ID NO: 409756 - DNA, 592 bp, Homo sapiens
  misc_feature: GZ8MTXP01APB7W.11.71.G05.1.454.CMB.2.raw
  modified_base (264)..(264): a, c, t, g, unknown or other
  modified_base (269)..(269): a, c, t, g, unknown or other
  modified_base (308)..(308): a, c, t, g, unknown or other
  modified_base (494)..(494): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggagtccctgagactctctgtacngcctntggctcaccttcattacctatggcatgcacgtgggtccnccagactccgaggccgagggggctggagtggggtgctagtttattcatagtgaatagggaattgtgtacttctattcgagtacctcccgtaggaacgggcctattccacccgttacctccaaggacgaactaaacttcccgaagggcccaacgaacggtcttagtactcgtgacaaagtcgaaacncgcctaggagaacgcgttaggacggttacgaacgggtcttaggttgttacgtttaaccgtggtaacgaacggtaaagttatttcgttaagttaagggg

SEQ ID NO: 409757 - DNA, 558 bp, Homo sapiens
  misc_feature: GZ8MTXP01CLKZ2.11.71.G05.1.454.CMB.2.raw
  modified_base (308)..(308): a, c, t, g, unknown or other
  modified_base (454)..(454): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggaggagtcgtgggggagcgtggtccagcctgggagtccctgagactctcctgtacagcctctggctcaccttcattacctatggcatgcacgtcggggtccnccagacctccgaggcgaggggggctggaggtggggtgctaggtttattcatatgaagttaggaattgtagactttctattcagactccgtagaggcattcacgtctccagacgacatccagcacgacgctgtactctgacaaagtnaaactgcctagagtaacgcgttggacggttaacgaccgggtcttaggttcgttacgtttaacgtaggtgaacggtaaaggttattttaacgttaagttaagggg

SEQ ID NO: 409758 - DNA, 600 bp, Homo sapiens
  misc_feature: GZ8MTXP01ANYV9.11.71.G05.1.454.CMB.2.raw
  modified_base (342)..(342): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacagcctctggcttcacccttcattacctatggcatgcacgtgggtcccgccagacctcccgaggcgagggggctgggaggtgggtgctagttatttcatntgataggaatgtgacttactattcagtacctccggtagaacgggtcccgatttcccacccgttcctacccgaagaacgacctaagttccccgaggaccacgaaccgctagtaactccgtagggactaaagtcgaaacacggccctggagagcctaggacggacgacgggtctgttaggtaattacgtaggttagacgttaaagttatttaacgagttaaggagggtcgttaacggtaaccgggggttcgtttaaccgg

SEQ ID NO: 409759 - DNA, 557 bp, Homo sapiens
  misc_feature: GZ8MTXP01A3KQY.11.71.G05.1.454.CMB.2.raw
  modified_base (307)..(307): a, c, t, g, unknown or other
  modified_base (459)..(459): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggaggagtcgtgggggagcgtggtccagccgtggggagtccctgagactctcctgtacagcctctggctcaccttcattacctatggcatgcactgggtccnccagactccgaggcagggggctggagtgggtgctagttattcatatgaaatgggaatcgtagacttctatcagactccgtagaacgggccgattcaccggtctaccagacgacaattccagcacgacgctagtactctgacaaagtgaaacngtccgtagacgtaagcgttaggaacggacgacggtcgttgttcgttaagttaacgtggttaagacggtaaaagttaccgtttaacgttaagttaaggg

SEQ ID NO: 409760 - DNA, 527 bp, Homo sapiens
  misc_feature: GZ8MTXP01B3MIW.11.71.G05.1.454.CMB.2.raw
  modified_base (262)..(262): a, c, t, g, unknown or other
  modified_base (267)..(267): a, c, t, g, unknown or other
  modified_base (308)..(308): a, c, t, g, unknown or other
  modified_base (342)..(342): a, c, t, g, unknown or other
  modified_base (353)..(353): a, c, t, g, unknown or other
  modified_base (375)..(375): a, c, t, g, unknown or other
  modified_base (470)..(470): a, c, t, g, unknown or other
  modified_base (499)..(499): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggagcgtggtccagcctgggagtccctgagactctctgtacngcctntggctcaccttcattacctatggcatgccacgtcgggtccnccagacctccgaggccgagggggctggagtgggngctagttattnatatgaataggaatgtgacttntattcagtactcgtgaggccgattcaccgtctccagacgacacttcaggcacgacgtctagtacgtctagacaaatacgaactgcctagaggaancgttggagacgagtcttgttgttattcgngtgacgtaattatttaacgaagtaaggg

SEQ ID NO: 409761 - DNA, 625 bp, Homo sapiens
  misc_feature: GZ8MTXP01D53RQ.11.71.G05.1.454.CMB.2.raw
  modified_base (247)..(247): a, c, t, g, unknown or other
  modified_base (294)..(294): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagcctgggagtccctgagactctcctgtacngcctctggcttcaccttcattacctatggcatgcacgtcgggtcccnccagacctccgaggcgagggggctgggaggtgggtgctagtttattcatatagataggtaaatgtgtactttactattcagtaccgtaccggtaggaacggggcctatttccgacccgttctaccgaagacgacctaacttaccgaggcctacgacgtctagtactctgggaactaaagtcgaaaccgagcccgtaggagacggccgtaggacggaccgtacggggttcttagttagttacgttacgtaggtaacggttaacgttaagttacgtttaagtaaggtaagggtacgggtacggttaccggggttaaccgggggttcgtttcgg

SEQ ID NO: 409762 - DNA, 620 bp, Homo sapiens
  misc_feature: GZ8MTXP01BBSZC.11.71.G05.1.454.CMB.2.raw
  modified_base (165)..(165): a, c, t, g, unknown or other
  modified_base (249)..(249): a, c, t, g, unknown or other
  modified_base (267)..(267): a, c, t, g, unknown or other
  modified_base (506)..(506): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgctattttaagnggtgtccagtgtcaggtgcaacgtggaggagtcgtgggggagcgtggtccaggccgtgggacgtccctgagactctcctgtacngcctctggcttcaccttnattacctatggcatcgacctacgtcgggtcccgccaggacctccgaggcgagggggctaggggaggttcgggggtgactaggtttattcattagtgtaacgtagggtaaaattggtacgtacttttaacattcgaagtacccgtaccggtagggaacgggtccctattcccgaccgtctacgaagacgaactaacttccgaggcacgacgactagtactcgagaactaaatacgaaacngccagagacgcgtaggacggacgcggtaactggttagtacttacgtagtacgaacggttaattacgttgtaagtaacggtaggtacgttaccgggtaacgggttcgtttaacgg

SEQ ID NO: 409763 - DNA, 596 bp, Homo sapiens
  misc_feature: GZ8MTXP01AR12F.11.71.G05.1.454.CMB.2.raw
  modified_base (244)..(244): a, c, t, g, unknown or other
  modified_base (254)..(254): a, c, t, g, unknown or other
  modified_base (263)..(263): a, c, t, g, unknown or other
  modified_base (266)..(266): a, c, t, g, unknown or other
  modified_base (270)..(270): a, c, t, g, unknown or other
  modified_base (280)..(280): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggtttcgcgttaggctctttaagaggtgtccagtgtcaggtgcaactggaggagtcgtgggggagcgtggtccagcctgggaggtccctgagactctcctgtacngctctgctcnctcatactngcntgcncgtcggtccncagcctcgaggcgaggggtctgggaggtgggtgctagtttatcatagtagagtaggaaatcgtgtacttactattcacgtactcggagggaacgggtcctacttccgaccgtactaccgagacgaactaacgtaccgacggacacgacgtctacgtacgtacgtacggaactaaacgtaacgaacgacgtacgtacggacgacggcgtacggtacggacgacggtcgtagttagttacgttacgtacgtagttaacgttaacgttacgttaagtagtaaggtacggtacggttacggtaacggggttcggttaacg

SEQ ID NO: 409764 - DNA, 624 bp, Homo sapiens
  misc_feature: GZ8MTXP01C7BTJ.11.71.G05.1.454.CMB.2.raw
  modified_base (247)..(247): a, c, t, g, unknown or other
  modified_base (294)..(294): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggagtccctgagactctcctgtacngcctctgcttcaccttcattacctatggcatcgcacgtcgggtcccncagacctccgaggcgagggggctagggagtggggtgctagtttatttcatatgtataggaaatgtgacttactattcgagtacctccggtaggaacgggtccgtaattcccaccgtctaccgagacaactaacttaccgaggccaacgacgtctagtactcgtaggaactaaatacgaaaccagtacccgtagaacgtacgccgtaggaacggacgaacgggtcgtagttacggttaattacgttaggtacgttaacggttaaagttacgttttaacgtaagttaacggtagggtacgggttacgggttaaccgggggttcgtttaacgg

SEQ ID NO: 409765 - DNA, 556 bp, Homo sapiens
  misc_feature: GZ8MTXP01AW560.11.71.G05.1.454.CMB.2.raw
  modified_base (307)..(307): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcgtgggtttcctcgttagctctttaagaggtgtccagtgtcaggtgcaactgggaggagtcgtgggggagcgtggtccagcctggggagtccctgagactctcctgtacagcctcgtggctcaccttcattaccatggcatgctacgtggtccncagctccagtcgagggggctgggagtgggtgctacggtttatttcatatgaaagtagggaatagtggaacttctattccagtacctccgtagaacgggtcctattccacgtctaccaagacgacaattccgaggccacgacgtctagtactcacgacaaaagtcgaacgtacgcctaggaagtaagcaggacggacgtaacgggcttagttcgttataacgtgtcgacgaagttcttaattaagtaagg

SEQ ID NO: 409766 - DNA, 560 bp, Homo sapiens
  misc_feature: GZ8MTXP01DIWOJ.11.71.G05.1.454.CMB.2.raw
  modified_base (272)..(272): a, c, t, g, unknown or other
  modified_base (317)..(317): a, c, t, g, unknown or other
  modified_base (348)..(348): a, c, t, g, unknown or other
  modified_base (359)..(359): a, c, t, g, unknown or other
  modified_base (381)..(381): a, c, t, g, unknown or other
  modified_base (507)..(507): a, c, t, g, unknown or other
tcagcgagagataccacgaccggtgctcgatttagtgtcgtcgcaagagagaggggggagctctgggagaggagcccagcactagaagtcggcggtgtttccattcggtgatcagcactgaacacagaggactcaccatggagtttgggctgagtcttggggtttttcctcgttgcttcttttaagaggtgtccagtgtcaggtgcaacgtgggaggagtcgtgggggagcgtggtccagccgtgggacgtccctgacgactctcctgtacngcctctggtctcaccttcattacctatggcatgcacgtcggtccnccagctccgaggcgagggggctggagtgggngctagttattnatatgaatagaatgtgtacttntatcagtactccgtagacggcgatcaccgtctacagagactatccagcacgacgtctagtactctagactaaatacgaaacgtacgacccgtgaacggaagtcttagggaacggacgtaaccggtnttaggttgttattcgtagtaagaacgtaagttactttaacgttaagttaaggg

SEQ ID NO: 409767 - DNA, 591 bp, Homo sapiens
  misc_feature: GZ8MTXP01CIYQP.11.71.G05.1.454.CMB.2.raw
  modified_base (292)..(292): a, c, t, g, unknown or other
  modified_base (459)..(459): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacagcctctggcttcacccttcattacctatggcatgcacgtcgggtcccnccagacctccgaggcgagggggctgggaggtgggtgctagtttattcatatgataggaaatgtgtacttctattcgagtaccgtccgtagaacggggtcccgattccacccgtctaccgagacgacaattcccgaggcacacgctgtatctaggacaaatcgaaacngcctaggagagcgtaggaacgggtaaaccggcgtaaggtagttaagtttacgttggttaaggaacggttaaaagttcttttacgtaagtaggtaagggtaggacgggttacgggggtctttcgtttaacggg

SEQ ID NO: 409768 - DNA, 574 bp, Homo sapiens
  misc_feature: GZ8MTXP01BV9DM.11.71.G05.1.454.CMB.2.raw
  modified_base (316)..(316): a, c, t, g, unknown or other
  modified_base (424)..(424): a, c, t, g, unknown or other
  modified_base (448)..(448): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtggggagtccctgacgctctcctgtacagcctctggtctcacccttctattaccctatggcatgcacgtcgggtcccnccagacctccgaggcgagggggctgggaggtggggtgctaggtttattcatatgaatagggaatagtgtacttcgtattcgagtactcgtgacggcattccaccgtcncagacgacactcagcacgcgcgtntactctagacctaaagtacgaactacgtaccgtagaacggaaggcgttagggaacgaccgacgggtcgttaggttgttacttaacgtggtaacgtacgtaagttactttaacgttaagttaacggg

SEQ ID NO: 409769 - DNA, 567 bp, Homo sapiens
  misc_feature: GZ8MTXP01DCM1Y.11.71.G05.1.454.CMB.2.raw
  modified_base (277)..(277): a, c, t, g, unknown or other
  modified_base (295)..(295): a, c, t, g, unknown or other
  modified_base (339)..(339): a, c, t, g, unknown or other
  modified_base (437)..(437): a, c, t, g, unknown or other
  modified_base (519)..(519): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtggggggaggcgtggtccagccgtgggagtccctgagactctcctgtacagtctctggcttcaccttcaattacctanggcatgcacgtgggtccncagactccgaggcgagggggctgggagtgggtgctagtttattnatatgataggaaaatgtgacttactattccaagtacctccggtaggaacggccgattcccacgtctaccgaagacacaacgtacacggcaacacgctntactctggaactaaagacgaacgacgcctagagagcgtagaaggaccagggtctagttgtattacgtagtagaagaaagttntttaagtaagtaaggaagggtcgaacgggttccggggttcgtttaacg

SEQ ID NO: 409770 - DNA, 564 bp, Homo sapiens
  misc_feature: GZ8MTXP01DZKQN.11.71.G05.1.454.CMB.2.raw
  modified_base (249)..(249): a, c, t, g, unknown or other
  modified_base (294)..(294): a, c, t, g, unknown or other
  modified_base (482)..(482): a, c, t, g, unknown or other
  modified_base (497)..(497): a, c, t, g, unknown or other
  modified_base (502)..(502): a, c, t, g, unknown or other
  modified_base (514)..(514): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccaggcctgggaggtccctgagactctcctgtacngcctctggcttcaccttcattacctatggcatgcacgtgggtccncagactccgaggcgagggggctagggaggtgggtggctagtttatttcgatagtgaataggaaattggtgtactttctaattcgagtacctccggtagaacgggcccgtattcccaccgtctaccagacgacaattaccgagcacacgctagtactctacggactaaagtacgaacagcctagagagntaggacgacacggtntgttntattagtggtanacgttattattaatagtaaggtaggtggttacggtaacggggttcgttcg

SEQ ID NO: 409771 - DNA, 623 bp, Homo sapiens
  misc_feature: GZ8MTXP01B6QK2.11.71.G05.1.454.CMB.2.raw
  modified_base (250)..(250): a, c, t, g, unknown or other
  modified_base (255)..(255): a, c, t, g, unknown or other
  modified_base (298)..(298): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtggggggagcgtggtccagccgtggggagtccctgacgactctcctgtacngcctntggcttcaccttcattacctatggcatgctacgtcgggtcccncagacctccgaggcgagggggctgggagtggggtgctaggtttatttcattagtagtataggtaaatgtgtactttactattcagtcctccggtagaacgggcctattcccgaccgtctaccagacgactaactccacggcacgacgtctagtatctaggactaaagtcgaaaccacgccgtaggacgacgtcgtaggacggacgtcggtaattcggttagttacgttacgtaggtacggttaacggttaaaagttactttaacgtaggttaagggtacgggttacgggttaaccgggttaaccggggggttcgttttaaccggg

SEQ ID NO: 409772 - DNA, 601 bp, Homo sapiens
  misc_feature: GZ8MTXP01CVICS.11.71.G05.1.454.CMB.2.raw
  modified_base (291)..(291): a, c, t, g, unknown or other
  modified_base (518)..(518): a, c, t, g, unknown or other
  modified_base (551)..(551): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggagtccctgagactctcctgtacagcctctggcttcaccttcattacctatggcatgcacgtgggtcccnccagacctccgaggcgaggggggctgggaggtggggtggctaggtttatttcaattattggaacttagggaaaattggtagtactttacgttaattcaagtaccttcccgggtaggaacggggcctattcccacccgtctaccaagacgacaattccgaggtcacacgctagtactctaggacaaagtcgaaacagccctagagacgcgtaggacggacgccgggtntggttagttattacgtggtgaacgttaaagttntttaactagtaacggagggttaggaccggttaacgggggttcgtttaacg

SEQ ID NO: 409773 - DNA, 607 bp, Homo sapiens
  misc_feature: GZ8MTXP01CD190.11.71.G05.1.454.CMB.2.raw
  modified_base (292)..(292): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggagtcctgagactctcctgtacagcctctggcttcaccttcattaccctatggcatgcacgtgggtccnccagacctccgaggcgagggggctgggagtgggtgctagtttattcatatgataggaaatgtgtacttactattcaagtacgttccggtaggaaacggggccctaattcccacccgttctaccgaagacgaactaacttaccgaaggccacaccgtctagtactcctagggaactaaagtacgaaaccagtcccgaggacgagccgtaggaacggaccgaacggtcttagttagttaattacgtagtacgaacgttaaagttagtttaactaagtaaggtacggtagttaccggttaacgggggttctttaacgg

SEQ ID NO: 409774 - DNA, 515 bp, Homo sapiens
  misc_feature: GZ8MTXP01BY76O.11.71.G05.1.454.CMB.2.raw
  modified_base (183)..(183): a, c, t, g, unknown or other
  modified_base (306)..(306): a, c, t, g, unknown or other
  modified_base (346)..(346): a, c, t, g, unknown or other
  modified_base (349)..(349): a, c, t, g, unknown or other
  modified_base (370)..(370): a, c, t, g, unknown or other
  modified_base (433)..(433): a, c, t, g, unknown or other
  modified_base (469)..(469): a, c, t, g, unknown or other
  modified_base (476)..(476): a, c, t, g, unknown or other
  modified_base (485)..(485): a, c, t, g, unknown or other
  modified_base (498)..(498): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagnggtgtccagtgtcaggtgcaacgtggaggagtcgtgggggagcgtggtccagccgtgggagtccctgagctctcctgacagcctctgctcaccttcatacctatcgcatcgcacgtcggcccnccagacctccgaggcgagggggctggagtggtgctagttnttnatatgaatagaatgtgacttntatcgagtactcgtagaacggcgatccacgtctcagagacatccagcacgactctgactcgtnacaaatcgaactgacctgagaagcgttgagacgcgngttgttnttagtctgngtacgtaaagttntttaacgaagttaaggg

SEQ ID NO: 409775 - DNA, 566 bp, Homo sapiens
  misc_feature: GZ8MTXP01CLUSJ.11.71.G05.1.454.CMB.2.raw
  modified_base (259)..(259): a, c, t, g, unknown or other
  modified_base (277)..(277): a, c, t, g, unknown or other
  modified_base (304)..(304): a, c, t, g, unknown or other
  modified_base (338)..(338): a, c, t, g, unknown or other
  modified_base (375)..(375): a, c, t, g, unknown or other
  modified_base (412)..(412): a, c, t, g, unknown or other
tcagcgagagataccacgaccggtgctcgatttagtgtcgtcgcaagagagaggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtggggggagcgtggtccaggccgtgggaggtccctggagactctctgtacngcctctggcttcaccttnatacctatggcatgcacgtcgggtccnccagacctccgaggcgagggggctgggagtgggngctagttattcatacgtgataggaaatgtagtacttntagttcagtactcgaggacgggcctattcaccgttcncagacgactaactccgaggacacgcgcttgtatcgtagacaaagtcgaaacgcgccgtagagcgtacgtcggaaggaaccaggcgttgttagttaacttcgttgttcgacgtaaagtatttaacgtaagtggaacggtcggaacggttcggggg

SEQ ID NO: 409776 - DNA, 570 bp, Homo sapiens
  misc_feature: GZ8MTXP01E26AH.11.71.G05.1.454.CMB.2.raw
  modified_base (293)..(293): a, c, t, g, unknown or other
  modified_base (327)..(327): a, c, t, g, unknown or other
  modified_base (524)..(524): a, c, t, g, unknown or other
  modified_base (529)..(529): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattaccctatggcatgcacgtgggtcccnccagacctccgaggcgagggggctgggagtgggngctagttattcatatgatggaaatgtgactttctattcagtactcccggtagaaacggggccgtaattccacccgttctacccgaagagaacctaattcccgaagggccacacgcttagtatctaggacctaaaatcgaaacagcctgagagcgtagaggaccaggctgttgtaattacgtgtagacgttaaagttnttttnaagttaaggagggtagacggttaacgggggttcgtttaacg

SEQ ID NO: 409777 - DNA, 600 bp, Homo sapiens
  misc_feature: GZ8MTXP01DYIAR.11.71.G05.1.454.CMB.2.raw
  modified_base (272)..(272): a, c, t, g, unknown or other
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagcctgggagtcctgagactctcctgtacagcctctggcttcaccttcattacctanggcatgcacgtcgggtccnccagactccgaggcgagggggctgggaggtgggtgctagtttatttcaattagtgaatagggaaaattacgtgtaactttctaatttccgaagtactcccggtaggaaacgggcccgtattcccaccgtctaccagagacaattaccaggcacacgctagtaatctacggacaaatacgaaacagcccgtagagaacgctaggacggacgacggtcgttgttaggtaatttacgtggttagaacggttaaaagttatttaacgtaagttaaggagggttacggacggttaacgggggttcgtttaacgg

SEQ ID NO: 409778 - DNA, 564 bp, Homo sapiens
  misc_feature: GZ8MTXP01CVRZ2.11.71.G05.1.454.CMB.2.raw
  modified_base (297)..(297): a, c, t, g, unknown or other
  modified_base (364)..(364): a, c, t, g, unknown or other
  modified_base (479)..(479): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtggggggaggcgtggtccagccgtgggaggtccctgagactctcctgtacagcctctggcttcaccttcattacctatggcatgcacgtcgggtcccnccagcctccgaggcgagggggctgggagtgggggtgctagtttatttcatagtgagtaggaaatgtnacttctattcagtactcggtagacggctatcaccgtctacagacgacatccagcacgacgtctgtactctacggacaaatgaactagcctagagagcgtaggacggacgacggtntaggttgttaattcgtaggtgaacgttaaagttatttcgtaagtaacgggtagggtcgacgggttaaccgggggttcgtttaacg

SEQ ID NO: 409779 - DNA, 626 bp, Homo sapiens
  misc_feature: GZ8MTXP01CTO52.11.71.G05.1.454.CMB.2.raw
  modified_base (266)..(266): a, c, t, g, unknown or other
  modified_base (310)..(310): a, c, t, g, unknown or other
  modified_base (354)..(354): a, c, t, g, unknown or other
  modified_base (569)..(569): a, c, t, g, unknown or other
tcagcgagagataccacgaccggtgctcgatttagtgtcgtcgcaagagagaggggggagctctgggagaggagcccagcactagaagtcggcggtgtttccattcggtgatcagcactgaacacagaggactcaccatggagtttgggctgagcttgggttttcctcgttgcttctttaagaggtgtccagtgtcaggtgcaacgtggaggagtcgtgggggagcgtggtccagccgtggggacgtccctgagactctcctgacngcctctgctcacttcattacctatcgctatgcacgtcggtcccncagacctccgaggtccgagggggctggagtggtgctagttattnatagtgaaacttaggaaacttgtacgtaactttctattacgaacgtacgtccggtagaacgggtccgtattccgacccgtctacccgaagtaacgaacctaacgttccgaacggaccacggacgtcgtagtacttcgagtaacaaagtacgaaccgtacgtaccgtagaagtaacggtacgttacgggaaacgaccggtaacggtcgttaggttnttaaacgttcgtagttaacggaaacgttaaagttacgtttccgttaaagggtaaggg

SEQ ID NO: 409780 - DNA, 660 bp, Homo sapiens
  misc_feature: GZ8MTXP01ARUKX.11.71.G05.1.454.CMB.2.raw
  modified_base (254)..(254): a, c, t, g, unknown or other
  modified_base (273)..(273): a, c, t, g, unknown or other
  modified_base (302)..(302): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtacaggtgcaacgtggaggaggtcgtggggggaggcgtggtccaggccgtgggacgtccctgacgactctctgtacngcctctggtcttcaccttnacttacctatggcatgcacgtgggtcccncagacctccgaggcgagggggctggagtgggtgctagtttattcatatgaataggaaatgtacgtactttactattcaagtacctccggttagaacggggtccgtattccacccgtctaccaagacgtaactaacgttaccacggacctaacgaccggtaccttaggttaacttcgtacggggtaactaaaagttcgggaaacctaccggtcccttagggaacggttaacgaccgtacgggaacggtaacgtaccggggtcttagggttacgttaagtttacgtagtagaacggttaaagttacgtttaagtaagtaagggtagggtacggttacgggttcggggttcgttttaaccg

SEQ ID NO: 409781 - DNA, 613 bp, Homo sapiens
  misc_feature: GZ8MTXP01CGDUD.11.71.G05.1.454.CMB.2.raw
  modified_base (289)..(289): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacagcctctggcttcaccttcattacctatggcatgcacgtgggtccncagactccgaggcgagggggctgggagtggggtgctagtttattcatatgatggaaatgtgtacttctattcagtactccggtagaacggggtcccattcccaccgtctaccagacgactaacttccgaggccacgacgcttagtactccgtagggactaaagtcgaaaccacgcccgtaggaagtacggcgtaggaacgggaccgacgggtcgttaggttaggttaacttacgtaggtacggttaaccgttaaaaggttattttaacgtaagttaagggtaggggttacggttaccgggttaacggggggttcttttaaccgg

SEQ ID NO: 409782 - DNA, 581 bp, Homo sapiens
  misc_feature: GZ8MTXP01DJQJ2.11.71.G05.1.454.CMB.2.raw
  modified_base (295)..(295): a, c, t, g, unknown or other
  modified_base (329)..(329): a, c, t, g, unknown or other
  modified_base (345)..(345): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagccgtgggagtccctgacgactctcctgtacagcctctggtcttcaccttcattacctatggcatgcacgtcgggtcccncagacctccgaggcgagggggctgggagtggggngtctagtttattcatntgactaggaaatgtgactttatattcagtacctccggtagaacgggcctattccgaccgtctaccgagacgactaacttccgagcacacgctgtactcgtggacaaatgaacacgcctagagaacgcgtaggacgaccgacggtcttggttattacgttcgtaggtcggaacgttaaattcgtttaactaaaggtaaggtacggggtgttaccgggttaacgggggcttttaacgg

SEQ ID NO: 409783 - DNA, 561 bp, Homo sapiens
  misc_feature: GZ8MTXP01ADC7C.11.71.G05.1.454.CMB.2.raw
  modified_base (268)..(268): a, c, t, g, unknown or other
  modified_base (304)..(304): a, c, t, g, unknown or other
  modified_base (354)..(354): a, c, t, g, unknown or other
  modified_base (467)..(467): a, c, t, g, unknown or other
  modified_base (519)..(519): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggagtcctgagactctcctgtacagcctntgctcaccttcattacctatgcatgcacgtggtccnccagactccgaggcgagggggctggaggtggggtggctaggtttactttnattatgaaattagggaattgtgtactttctaattcaagtacctccgtagaacggccgtattccaccgtcctaccagtacgacaacttaccgagtacacgacgtactgtactcngacaaacgtagaacagacctagagaagtcgaggacgacgacggtcttggttnttacttaacgtgtaagacgtaagttactttaacgaagtaagg

SEQ ID NO: 409784 - DNA, 580 bp, Homo sapiens
  misc_feature: GZ8MTXP01BIU9P.11.71.G05.1.454.CMB.2.raw
  modified_base (244)..(244): a, c, t, g, unknown or other
  modified_base (249)..(249): a, c, t, g, unknown or other
  modified_base (271)..(271): a, c, t, g, unknown or other
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggagtccctgagactctctgtacngcctntggcttcaccttcattacctanggcatcgcacgtgggtcccnccagacctccgaggcgagggggctgggagtgggtgctagttattcatatgatagggaaatgtgtacttctattcaagtacctccggtggaacgggccgtaattcccgaccgttctaccagacgactaattaccgaggtcacacgctgtatctaggactaaatcgaacagccgtgacgtagcgtaggacgacgcggtctggttagttacttaccgtggtcggaacgttaaaggttactttaacgtaagtaacggtagggtcggttacggttaacgggggttcgtttaacg

SEQ ID NO: 409785 - DNA, 589 bp, Homo sapiens
  misc_feature: GZ8MTXP01DJIHC.11.71.G05.1.454.CMB.2.raw
  modified_base (294)..(294): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggaggcgtggtccagccgtgggagtccctgagactctcctgtacagcctctggcttcaccttcattacctatggcatgcacgtcgggtcccncagcctccgaggcgagggggctgggagtgggtgctagtttatttcatatgaataggaaatgtgtacttactattcagtactcgtagaacgggctattccaccgtctaccagacgacaacttccgaggcacgacgctagtactcctaggactaaatcgaaaccagtccgtagaagagcgtaggaacggaccgacgggtcttggttagttaacttggtagtacgaacgttaaagttctttaactaaagttaacggtagggtcggttaaccgggttaacgggggttccgttttaacgg

SEQ ID NO: 409786 - DNA, 532 bp, Homo sapiens
  misc_feature: GZ8MTXP01ADJLH.11.71.G05.1.454.CMB.2.raw
  modified_base (357)..(357): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtggggggagcgtggtccagcctgggagtccctgagactctcctgtacagcctctggcttcaccttcattaccctatggcatgcacgtgggtcccgccagacctccaggcgaggggggctgggagtggggtgctagttatttcatatgactgggaaatgtnactttctattcagactccgtggaacgggccgattcaccgtctccagagacaattccagcacacgctgtatctggacaaatgaacagcctgagagctggaggacgcggctgttgttattacgtgtgacgaaagttatttctagtaaggaggtggacggtaacgggggcgtttaacg

SEQ ID NO: 409787 - DNA, 614 bp, Homo sapiens
  misc_feature: GZ8MTXP01ECZYS.11.71.G05.1.454.CMB.2.raw
  modified_base (247)..(247): a, c, t, g, unknown or other
  modified_base (275)..(275): a, c, t, g, unknown or other
  modified_base (293)..(293): a, c, t, g, unknown or other
  modified_base (326)..(326): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggagtccctgagactctcctgtacngtcctctggcttcaccttcattacctanggcatgcacgtcggtccncagacctcgaggcgagggggctggagtgggtgntagttattcatatgtaataggtaaaattggtactacttactaattcgagtaccgtccggtaggaaacgggtccctattccacccgtctccaagacgaactaacttccgagccacgacgtctagtatctaggaactaaagtacgaaacacgaccctaggaacgacgcgtacgggaacggacgaaccgggttcgttggttacgttacgttacgtagtacggttaacgttaaagttactttaacgaagttaaggtacgggtacggttaccgggttcggggttcgtttaacg

SEQ ID NO: 409788 - DNA, 584 bp, Homo sapiens
  misc_feature: GZ8MTXP01CTKX6.11.71.G05.1.454.CMB.2.raw
  modified_base (249)..(249): a, c, t, g, unknown or other
  modified_base (277)..(277): a, c, t, g, unknown or other
  modified_base (294)..(294): a, c, t, g, unknown or other
  modified_base (360)..(360): a, c, t, g, unknown or other
  modified_base (462)..(462): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggagtccctgagacctctcctgtacngcctctggcttcaccttcattaccctanggcatgcacgtggcccncagacctccgaggcgagggggctgggaggtgggtggctagtttattcattatgataggaaattgtntacttctattcagtcctcggtaggaacgggcctattcccaccgtctaccagaagacctaataccgaggaccacgacgctgtatctaggactaaagtcgaacngccgtagagacgctaggacggacgcggtcttggttagtttattacgttagtcgacgttaaaagttgtttaacgtagtaagggacggttcggttaaccggtaacgggggttccgttttaacgg

SEQ ID NO: 409789 - DNA, 549 bp, Homo sapiens
  misc_feature: GZ8MTXP01AP1RV.11.71.G05.1.454.CMB.2.raw
  modified_base (258)..(258): a, c, t, g, unknown or other
  modified_base (303)..(303): a, c, t, g, unknown or other
  modified_base (374)..(374): a, c, t, g, unknown or other
  modified_base (462)..(462): a, c, t, g, unknown or other
  modified_base (500)..(500): a, c, t, g, unknown or other
  modified_base (515)..(515): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagcctgggagtccctgagactctcctgtacngcctctggcttcaccttcatacctatggcatgcacgtgggtcccnccagactccgaggcgagggggctggagtgggtgctagttattcatagtgagtggaaaactgtagtactttntaattcagacctccggtaggaacgggtccattccaccggtctaccgagagactactccgagcacacgctgtactctgacaaatgaacngcctaggagtagcgtagaggcaggctgttgtaattcgngttcgacgtaaagtntttaacgagtaggaggtcgaacggttaacggggg

SEQ ID NO: 409790 - DNA, 808 bp, Homo sapiens
  misc_feature: GZ8MTXP01DCRY6.11.71.G05.1.454.CMB.2.raw
  modified_base (294)..(294): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtggggggagcggtggtccagccgtgggagtccctgagactctcctgtacagcctctggcttcaccttcattaccatggcatgcacgtggtcccncagacctccgaggcgagggggctgggaggtgggtcggtacgtagtttatttcaagttagtaggtaaacgttaggggtaaaaaacttggttacgtaaccttttacgttaaactttccgaaaggtaacccgttcccgggtaaggaaaccgggggtcccgtaacgttcccgaaccccgttctaaccccgtaaagggaactaaccgtaaacttacccgaacgggtaccctaaaccgaaccggtccttaggttaacttacccggttaacgtaaacccggttaaaaaattaccgggtaaaacccgtaacggaaccccggttaaggtaaacgggaaacgtccggtaaacggggaacggaaacccggtaacgggttccgttagggttaacggtttaaccgttaacggttaggttacggttaaaaccgttaaagttaacccgtttttaagtaaaaggttaacgggttaaagggggttccggttaaaccggggtttaaccggggggttccgtttttaaccgggg

SEQ ID NO: 409791 - DNA, 621 bp, Homo sapiens
  misc_feature: GZ8MTXP01CUVCH.11.71.G05.1.454.CMB.2.raw
  modified_base (293)..(293): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggagtccctgagactctcctgtacagcctctggtcttcaccttcattacctatggcatgcacgtgggcccncagactccgaggcgagggggctgggaggtggggtgctaggtttatttcgaattagtagaattagggaaaacttgtcgtaacttactaattcgaagtacctccggtaggaacgggccgtattcccaccgtctaccgaaggactactaaacgttccgaacggtacacgacgcttagtacttccgtagggacctaaagtacgaaacgcgtaccgaggacgagtccgtaggaacggtaccgacggtcttagttagttacttacgtaggtgttaaacggttaaattgtttaatagtaaggtaggtcggttacggttcgggggttctttaacgg

SEQ ID NO: 409792 - DNA, 605 bp, Homo sapiens
  misc_feature: GZ8MTXP01AI686.11.71.G05.1.454.CMB.2.raw
  modified_base (268)..(268): a, c, t, g, unknown or other
  modified_base (273)..(273): a, c, t, g, unknown or other
  modified_base (311)..(311): a, c, t, g, unknown or other
  modified_base (356)..(356): a, c, t, g, unknown or other
tcagcgagagataccacgaccggtgctcgatttagtgtcgtcgcaagagagaggggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtggggggagcgtggtccagccgtgggacgtccctgagactctcctgtacngcctntggctcaccttcattaccatggcatgcacgtggtcccncagactccgaggcgagggggctggagtgggtgctagttattcatntgaatagaatcgtgtacttctattcagtactcgtagacgggcgtacttcacccgtctcgaagtacgaactaacgttccgaacggaccacgtaacggtcttggttaacctcgtacgactaaaacttacggaaaccgagtacccgtaggaggaacgtccggttagggacggaaccgtacgggtcgttggttagttacgtttaacgtaggttaacggaacgttaaagttacgttttaacgttaagtaagggg

SEQ ID NO: 409793 - DNA, 558 bp, Homo sapiens
  misc_feature: GZ8MTXP01C5APF.11.71.G05.1.454.CMB.2.raw
  modified_base (235)..(235): a, c, t, g, unknown or other
  modified_base (251)..(251): a, c, t, g, unknown or other
  modified_base (276)..(276): a, c, t, g, unknown or other
  modified_base (295)..(295): a, c, t, g, unknown or other
  modified_base (412)..(412): a, c, t, g, unknown or other
  modified_base (426)..(426): a, c, t, g, unknown or other
  modified_base (428)..(428): a, c, t, g, unknown or other
  modified_base (454)..(454): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtggggggagcgtggtccagccgtggggacgtcccngagactctcctgtacngcctctgcttcaccttcattaccanggcatgcacgtcggtcccncagacctccgaggcgagggggctgggagtgggtgcagtttattcatagtgaataggaaatggtagtacttactattcgagtaccgtccggtagaacgggcctatccacgtcacaganactaactcagcacncnctgtatcgtagactaaatcgaaaccngccgtagacgagcgtggaacgacgaggtctgttagttattacgtgtacgagttaagttactttaagaagtggtaggtacgttacgggtcggggttctttaacgg

SEQ ID NO: 409794 - DNA, 727 bp, Homo sapiens
  misc_feature: GZ8MTXP01DP5IK.11.71.G05.1.454.CMB.2.raw
  modified_base (251)..(251): a, c, t, g, unknown or other
  modified_base (308)..(308): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgctcttttaagaggtgtccagttgtcaggtgcaactggaggagtcgtggggggagcgtggtccagccgtggggacgtcctgacgtactctcctgtacngcctgtcgtcttcaccttcacttacctagtcggcattcgactacggtcgggtccccncaagaccctccgagggcggagggggtctagggagggttggggtcgtacttaggtttactttcaagttagtaggtaacgtacggggtaaaaattggtacgttaacctttctaatttcgacgtaccgttacccgggtaggtaaaccgggcccgttattccccgtaccgttctacccgaagaacgtaactaaacttaccccgaggaccaaccgtacggtacctaggttaacttctaacgggaacctaaaagttacgaaacgtacgtaccgtaggaagaacggccgtaggaacggaccgtaccggtaacgtttagttagtttaacgtttacgtaggttaacggaaacgttaaacgttactttaagttaagtaacgggttaagggtacggttaacgggttaaccgggggttcgttttaaccggg

SEQ ID NO: 409795 - DNA, 585 bp, Homo sapiens
  misc_feature: GZ8MTXP01D6AM5.11.71.G05.1.454.CMB.2.raw
  modified_base (292)..(292): a, c, t, g, unknown or other
  modified_base (337)..(337): a, c, t, g, unknown or other
  modified_base (351)..(351): a, c, t, g, unknown or other
  modified_base (358)..(358): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagcctgggagtccctgagactctcctgtacagcctctggcttcaccttcattacctatggcatgcacgtgggtcccnccagacctcgaggcagggggctggagtggggtgcagttattcatntgataggaaatgtntaccttntattcagtacctccgtaggaacgggtcctattcccacccgtctaccgagtacgtaactaattcccgaggtaccacgaccgtctagttactctgggaactaaagtacgaaacgagcctaggagaacggtctaggaacggacgtcggaacttggttgttattacgtggtgaaccgttaagttattctaagtaacgtgggtacggacggttaacgggggttctttaacgg

SEQ ID NO: 409796 - DNA, 599 bp, Homo sapiens
  misc_feature: GZ8MTXP01DN2GP.11.71.G05.1.454.CMB.2.raw
  modified_base (251)..(251): a, c, t, g, unknown or other
  modified_base (281)..(281): a, c, t, g, unknown or other
  modified_base (301)..(301): a, c, t, g, unknown or other
  modified_base (355)..(355): a, c, t, g, unknown or other
  modified_base (368)..(368): a, c, t, g, unknown or other
  modified_base (411)..(411): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcggtgggggagcgtggtccagccgtgggacgtccctgacgactctcctgtacngcctcgtgtccttcaccttcattaccctanggcatgcacgtcgggtcccncagacctccgaggcgagggggctgggagtggggtgacgtagtttattcattagngaatggaaatgtnacttctatcgagtacctcggtagaacgggcctatcccacgtcnccgaagacacgtaataccgagaccacacgctagtactctaggactaaagtcgaaacgtagcagagacgtcgtagacggactcggaacttagttggttaacttacgtagtaagaacgttaaaagttagtttaacgtaaggttaacgggtaagggttcggttaaccgggttcgggggttcctttaacggg

SEQ ID NO: 409797 - DNA, 750 bp, Homo sapiens
  misc_feature: GZ8MTXP01AIWMK.11.71.G05.1.454.CMB.2.raw
  modified_base (322)..(322): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggaggtcgtggggggaggcgtggtccagccgtggggacgtccctgacgactcctcctgtacacgtccctcgtcggtcctttcaccctttcaatttaccctagtggcatcggcctacgtcggggtccccnccagacctccgagggcgaggggggctggggaggttgggggtcgctaggttttatttcgaattgtaggaacgttagggtaaaattggtacgtaactttactaagtttccgagtacccgttcccgggtagggaaaccggggtccctaactttcccgacccgttctacccgaagaacgtaacctaacgtttaccccgagggtacccaaccgtaccgtccttaggttaacttccgtacggtaaactaaaacgttacggaaaaccacggtcccgtaagaacggtacgtaccgtagggaaacggtaccgacgggtcttggttacggttacgttacgtacgggttacgaaacggttaaagtttacgtttaaccgtaaggttaacgggtacggggtacggttaaccgggggttaacgggggttcccgttttaaggg

SEQ ID NO: 409798 - DNA, 629 bp, Homo sapiens
  misc_feature: GZ8MTXP01AJS2I.11.71.G05.1.454.CMB.2.raw
  modified_base (249)..(249): a, c, t, g, unknown or other
  modified_base (296)..(296): a, c, t, g, unknown or other
  modified_base (335)..(335): a, c, t, g, unknown or other
  modified_base (338)..(338): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggacgtccctgagactctcctgtacngcctctggcttcaccttcattacctatggcatgcacgtcgggtcccnccagcctccgaggcgaggggctggagtgggtgctagttnttnatatgagtaggaaatgtgtacttatattcagtaccgtcggaggacgggctacttccaccgtcaccgagacgactaacgtccgaagccacgcgtctagtctacgtacggaactaaagtcgaaaccgtcgccgtaggacggaacgtccgtaagggacccggacgccgggtaattcgggttattaaaccgtttagtacggttaacggttaacggttaaacggttatttttaacggaaagttaagggtacgggggtacgttaaccggggttccgggggttaacttttaacccggg

SEQ ID NO: 409799 - DNA, 578 bp, Homo sapiens
  misc_feature: GZ8MTXP01AD84Y.11.71.G05.1.454.CMB.2.raw
  modified_base (266)..(266): a, c, t, g, unknown or other
  modified_base (310)..(310): a, c, t, g, unknown or other
  modified_base (357)..(357): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggacgtccctgagactctcctgtacngcctctggctcaccttcattacctatggcatgcacgtggtcccnccagacctccgaggcgagggggctgggacggtgggtgctagttattnatatgaaatagggtaatgtgtacttctattcgagtaccgtccgtagaacgggcctattccgaccgtctaccagtacgactaacttccgaggaccacgacgtctgtactctgacaaagtacgaacacgtcctaggagaacgcgttaggacggacgacggtcgttggttgttacgttaacgtggtaacgtaacgtaaaggttatttaacgttaagttaagggg

SEQ ID NO: 409800 - DNA, 544 bp, Homo sapiens
  misc_feature: GZ8MTXP01A46L3.11.71.G05.1.454.CMB.2.raw
  modified_base (308)..(308): a, c, t, g, unknown or other
  modified_base (479)..(479): a, c, t, g, unknown or other
  modified_base (528)..(528): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagccgtgggagtccctgagactctcctgtacagcctctggctcaccttcattacctatggcatgcacgtgggtcccnccagacctccgaggcgaggggggctgggaggtggggtggctagtttatttcatatgaatagggaatgtgacttctattcagtactccgtgaacgggccgattccaccgtctccagacgacaacttccaggcacgacgctgtatctgacaaatcgaaactagcctagagaancgttaggaggacgacgggtcttgttgttacttctgtcgacgtaaagttntttaacgaagtaaggg

SEQ ID NO: 409801 - DNA, 558 bp, Homo sapiens
  misc_feature: GZ8MTXP01EW3SB.11.71.G05.1.454.CMB.2.raw
  modified_base (246)..(246): a, c, t, g, unknown or other
  modified_base (251)..(251): a, c, t, g, unknown or other
  modified_base (264)..(264): a, c, t, g, unknown or other
  modified_base (291)..(291): a, c, t, g, unknown or other
  modified_base (318)..(318): a, c, t, g, unknown or other
  modified_base (352)..(352): a, c, t, g, unknown or other
  modified_base (517)..(517): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtgggttttcctcgttgcttcttttaagaggtgtccagtgtcaggtgcaactggaggagtcgtgggggagcgtggtccagcctgggagtccctgagactctcctgtacngcctntggcttcaccttnattaccatggcatgcacgtcgggtccnctagactccgaggcgagggggctgggngtgggtgctagttattcatatgataggaaatgtntacttactattcaagactcccggtagaaacggggtcctaattccaccgtctaccgagtagactaattccgacgcacacgctgtatctaggactaaatgaaacacgcctgagagtcgtgaggaccgacggctggttagtattacgtagtagacgttaagttatttntaagtaaggtagggttagacggttaacgggggttcgtttcg

SEQ ID NO: 409802 - DNA, 526 bp, Homo sapiens
  misc_feature: GZ8MTXP01D4PQD.11.71.G05.1.454.CMB.2.raw
  modified_base (261)..(261): a, c, t, g, unknown or other
  modified_base (306)..(306): a, c, t, g, unknown or other
  modified_base (342)..(342): a, c, t, g, unknown or other
  modified_base (356)..(356): a, c, t, g, unknown or other
  modified_base (375)..(375): a, c, t, g, unknown or other
  modified_base (423)..(423): a, c, t, g, unknown or other
  modified_base (442)..(442): a, c, t, g, unknown or other
  modified_base (479)..(479): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggaggagtcgtgggggagcgtggtccagcctgggagtccctgagactctcctgacngcctctggctcaccttcattacctatggcatgcacgtcgggtccnccagactccgaggccgagggggctgggacgtggggngctagttattcatntgaataggaatgtgacttntattcagtactcgtgaggcatccacgtctcagagacatcagcacgacntgtatcagcaaatagaacngccgtgagaacgcttggacgggacgacggtcttgttnttagttaacgtgtaaggtaacgaaagttctttaacgaagttaagggg

SEQ ID NO: 409803 - DNA, 640 bp, Homo sapiens
  misc_feature: GZ8MTXP01EN97F.11.71.G05.1.454.CMB.2.raw
  modified_base (268)..(268): a, c, t, g, unknown or other
  modified_base (313)..(313): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggacgtccctgacgtactctcctgtacncgcctctggtctcaccttcattacctatggcatgcacgtcggccncagacctcgaggcgagggggctgggagtggggtgtctaggtttatttcgaagttagtaggaaacgttaagggtaaattgtagtactttcgtaagtttcaaggtaccgttccggtaggaaaccgggtccgtacttaccgacccgttactacccgtaagaccgtaactaacgttaccgaaggccaacgtacgtcttagtactctacgacctaaagtacgaaacgacgtaccgtaggaacggaagtccgttagggaaccggacgtaaccgggtgttagttcgttagttaacgtggtaacgaacgtaagttactttaacgttaagtaaggg

SEQ ID NO: 409804 - DNA, 596 bp, Homo sapiens
  misc_feature: GZ8MTXP01A5QZD.11.71.G05.1.454.CMB.2.raw
  modified_base (262)..(262): a, c, t, g, unknown or other
  modified_base (267)..(267): a, c, t, g, unknown or other
  modified_base (303)..(303): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggaggagtcgtgggggagcgtggtccagcctgggagtccctgagactctcctgtacngcctntgctcaccttcattacctatggcatgcacgtggccnccagactcaggcagggggctgggagtgggtgctagttattcgatatgaaatgggaatgtgtactttactattcagtacctccgtagaacgggccgtattccgaccgttctacccgagacgacctaacgttccgaaggcctacggacgcttgtactcgtagacctaaagtacgaaacgtcgaccgttaggaggtaacgaccgttgggaaacggaccgaacgggtccttaggttcgttagtttaaccgtggttaacggtaacggtaaagttacgtttaacgttaagttaaagggg

SEQ ID NO: 409805 - DNA, 567 bp, Homo sapiens
  misc_feature: GZ8MTXP01BBG7U.11.71.G05.1.454.CMB.2.raw
  modified_base (266)..(266): a, c, t, g, unknown or other
  modified_base (306)..(306): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacagcctntggctcaccttcattacctatggcatgcacgtgggtcccnccagactccgaggccgagggggctgggagtggggtgctagtttatttcagtatgaaattagggaattgtgtaactttctaattcaagtacctccgtaggaacggccgtattccacgttctaccgagacgacaacttccgaggccacgacgtctagtactctgacaaagtcgaaactacgcctaggacgaagcgttggacggacgacgggtcttgttgttattaacgtgtaacgacgtaaagttctttaagttaagtaaggg

SEQ ID NO: 409806 - DNA, 536 bp, Homo sapiens
  misc_feature: GZ8MTXP01DQC05.11.71.G05.1.454.CMB.2.raw
  modified_base (269)..(269): a, c, t, g, unknown or other
  modified_base (314)..(314): a, c, t, g, unknown or other
  modified_base (355)..(355): a, c, t, g, unknown or other
  modified_base (485)..(485): a, c, t, g, unknown or other
tcagcgagagataccacgaccggtgctcgatttagtgtcgtcgcaagagagaggggggagctctgggagaggagcccagcactagaagtcggcggtgtttccattcggtgatcagcactgaacacagaggactcaccatggagtttgggctgagcttggggtttttcctcgttgcttcttttaagaggtgtccagtgtcaggtgcaacgtggaggagtcgtgggggagcgtggtccagccgtgggacgtccctgagactctcctgtacngcctctggctcaccttcattacctatggcatcgcacgtcggtccncagctccgaggcgagggggctggagtgggtgctagttattnatatgaataggaatgtgtacttctattcagtctcgtgaacggccattccacgtctcagacgacatcagacacgacgctatatctgacaaatcgaactagcctaggagcgcgttaggacggacgaccggtnttaggttgttattcgtaggtgaacgtaaagttctttaacgttaagtaaggg

SEQ ID NO: 409807 - DNA, 679 bp, Homo sapiens
  misc_feature: GZ8MTXP01DAE7Y.11.71.G05.1.454.CMB.2.raw
  modified_base (295)..(295): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagccgtgggagtccctgacgactctcctgtacagcctctggcttcaccttcattacctatcggcatgcacgtcgggtcccncagacctccgaggcgagggggctgggagtggggtgctaggtttatttcatagtgtatagggtaaaatggtagtacctttacttatttccgagtacccgttccggtagggaacgggtccgtaactttcccgaacccgttctacccgaagaacgtaaccgtaaaacttcccgaacgggacccaaccgtaaccggccttaggtaaacttcccgttaaggggaaacctaaaacgttacgggaaaccacggtccctagggaaccgagtccgtaggaacgggaccgtacgggtctaggttcgttaaacgttcgttggtaaccggaacgttaaagttacttttaacgaaagttgtaaagggtcggaacggtttccgggggcttttaaccgg

SEQ ID NO: 409808 - DNA, 578 bp, Homo sapiens
  misc_feature: GZ8MTXP01AC5HX.11.71.G05.1.454.CMB.2.raw
  modified_base (251)..(251): a, c, t, g, unknown or other
  modified_base (292)..(292): a, c, t, g, unknown or other
  modified_base (355)..(355): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggaggtccctgagactctcctgtacagcctntggcttcaccttcattacctatggcatgcacgtgggtcccnccagacctccgaggcgagggggctgggaggtgggtgctagtttattcatatgatggaaatgtnacttctattcagtacctcggtagaacgggcctattccaccgtctaccgagacgactaactcccgaggccacgacgctagtatctaggacaaagtgaaacagcctagagacgcgtggaacggaccgcggtctggttagtaattacgtggtagaccgttaaaagttactttaacgtaagtaagggtacgggtaggttaccgggttaaccgggggttcgtttccgg

SEQ ID NO: 409809 - DNA, 581 bp, Homo sapiens
  misc_feature: GZ8MTXP01D07K5.11.71.G05.1.454.CMB.2.raw
  modified_base (338)..(338): a, c, t, g, unknown or other
  modified_base (344)..(344): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagcctgggagtccctgacgactctcctgtacagcctctggtcttcaccttcattacctatggcatcgcacgtcgggtcccgccagacctccgaggcgagggggctgggagtgggtgctagtttnttcatntgataggaaatgtgtacttctattcgagtaccgtccggtagaacgggccctattcccaccgtctaccagacgactaattccgacggcacgacgctagtactctaggactaaatacgaacgacgtcccgagacgaacgcgtaggacggacgacggtcttgttcgttattacgtgtagaacgttaagttatttaagtagtaaggtaggtcgttacgggttaacgggggttctttaacgg

SEQ ID NO: 409810 - DNA, 622 bp, Homo sapiens
  misc_feature: GZ8MTXP01C83OQ.11.71.G05.1.454.CMB.2.raw
  modified_base (297)..(297): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagccgtgggagtccctgagactctcctgtacagcctctggtccttcaccttcattacctatggcatgcacgtcgggtcccncagacctccgaggcggagggggctgggacggtggggtacggctaggtttatttcaatagtgtaactagggtaaaattgtacgtactttactattcgaagtacctcggtagaacgggtcctattccacccgtctaccaagacgaactaactaccgaggtacacacgctagtactactaggaactaaatacgaaaccagaccctaggacgtaacgcgtaggacggaacgtacggtaacttggttagttattacgttagtagaacgttaaagttatttaagtagtaaggtagggtcggttacgggttaacggggttcgttttaaccgg

SEQ ID NO: 409811 - DNA, 559 bp, Homo sapiens
  misc_feature: GZ8MTXP01A92KZ.11.71.G05.1.454.CMB.2.raw
  modified_base (294)..(294): a, c, t, g, unknown or other
  modified_base (356)..(356): a, c, t, g, unknown or other
  modified_base (360)..(360): a, c, t, g, unknown or other
  modified_base (371)..(371): a, c, t, g, unknown or other
  modified_base (471)..(471): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagccgtgggagtccctgagactctcctgtacagcctctggcttcacccttcattaccctatggcatgcacgtgggtcccnccagacctccgaggcagggggctgggagtggggtgctagtttattcatatgatggaaatgtnactntatcagctcgngaagggccattccaccgtctaccagacgacaattccaggtcacacgctagtatcctggactaaagtcgaaactagccgtgagacgctaggagaccgacgnttggttgttattacgtggtagttaacgaaagttactttaacgtaagtggtaagggtggttaccgggtaaccgggggttcgtttaacgg

SEQ ID NO: 409812 - DNA, 593 bp, Homo sapiens
  misc_feature: GZ8MTXP01AJMAW.11.71.G05.1.454.CMB.2.raw
  modified_base (264)..(264): a, c, t, g, unknown or other
  modified_base (278)..(278): a, c, t, g, unknown or other
  modified_base (306)..(306): a, c, t, g, unknown or other
  modified_base (380)..(380): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtgggaggagtcgtgggggagcgtggtccagccgtgggagtccctgagctctcctgacngcctctgctcactnattacctatgcatgctacgtcggtcccncagacctccgaggcgagggggctgggaggtggggtcgctagtttattcatagtgaataggtaatgtatactttnattcagtactccgtaggacggtcgattccaccgtctccgaagacgaactacttaccgacggaccaacggtaccgtcgttagtacttcacgaacaaagtacgaaacgtacggtccgtagaacggtaaggaccgttagggaacggacggaccggtcgttggttcgttacgttaacgtggtaacgaacgtaagttactttaacgttaagttaaggg

SEQ ID NO: 409813 - DNA, 612 bp, Homo sapiens
  misc_feature: GZ8MTXP01E3B99.11.71.G05.1.454.CMB.2.raw
  modified_base (259)..(259): a, c, t, g, unknown or other
  modified_base (265)..(265): a, c, t, g, unknown or other
  modified_base (305)..(305): a, c, t, g, unknown or other
  modified_base (376)..(376): a, c, t, g, unknown or other
  modified_base (466)..(466): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggacgtccctgagactctcctgtacngtcctntggcttcaccttcatacctatggcatgcacgtcggtcccncagctccgaggcgagggggctggaggtgggtgactagttatttcatagtgataggaaatgtaagtactttntatcaagtaccgtcggtaggaaacgggccgtacttccaccgtctccgagacgaactaacttccgacggacaccgacgctagtactcgtanacctaaagtacgaacgagaccgtagaagaggtcgtacggaacgggaacctacggttcgtagttgggttaaattacgttaggttcgaacggtaaagttcgtttaacgtaagtagggttaggtaacggttaacggggttaaccggggg

SEQ ID NO: 409814 - DNA, 643 bp, Homo sapiens
  misc_feature: GZ8MTXP01DQKAW.11.71.G05.1.454.CMB.2.raw
  modified_base (279)..(279): a, c, t, g, unknown or other
  modified_base (299)..(299): a, c, t, g, unknown or other
  modified_base (498)..(498): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtggggggaggcgtggtccaggccgtgggaggtccctgacgtactctcctgtacagcctctggcttcaccttcacttacctanggcatcgcacgtcggtcccncagacctccgaggcgagggggctggggaggtggggtgtctagtttatttcattagtggtatagggaaattggtctacttacttattcgagtaccgtccgtaggacgggtcctattccaccgtctaccgagaacgactaacgttaccgagaccaccgacgtcgtagtaactctaacggggaactaaaacgtcgaaacccncgtaccgtaggaacgaacgtcgtaagggaacggtaccgtacggtcgttagttagttaacgttacgtacggtaagttaacggttaactttagtttaagtaaggttaagggtagggttacgttacggggttaacggggttcgtttcg

SEQ ID NO: 409815 - DNA, 749 bp, Homo sapiens
  misc_feature: GZ8MTXP01CEGI3.11.71.G05.1.454.CMB.2.raw
  modified_base (270)..(270): a, c, t, g, unknown or other
  modified_base (300)..(300): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtgggttttcctcgttgctctttaagaggtgtccagtgtcaggtgcaacgtggaggagtcgtgggggaggcgtggtccagccgtgggacgtccctgagactctcctgtacacgcctctggtcttctacccttnacttacctatggcatgcacgtcgggtcccnccagacctccgaggcgagggggctgggaggtggggtgggtctaggtttatttcgaattagtagtaagtagggaaattacggtacgtacctttacttaatttcgaacgtacccgttacccgggtaggaaaccgggggtccctaagttccctacccgttccttaccccgaaggtaacggaaacctaaccgtttacccgaaccgggacctaacccgacccggtactttacggtaacttccgttaacgggaactaaaagttcgaaaaccgtacgacccgtaggaggaacgccggttaggaacgggaaaccgtcggggtccttaacggtttagggtttaaaccttacggttagggttaacgttaaaccgggttaaaggtttaccttttaagtaaggttaacggggtaagggttccgggttaaccggggttaaccggggggttcttttaaccggg

SEQ ID NO: 409816 - DNA, 661 bp, Homo sapiens
  misc_feature: GZ8MTXP01BBKXK.11.71.G05.1.454.CMB.2.raw
  modified_base (278)..(278): a, c, t, g, unknown or other
  modified_base (299)..(299): a, c, t, g, unknown or other
  modified_base (368)..(368): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggaggcgtggtccagccgtgggacggtccctgacgactctcctgtacagcctctggtcttcaccttcattacctanggcatcgcacgtcgggtcccnccagacctccgaggcgagggggctgggaggtgggtgctaggtttatttcatatgaacgtaggaaatgtntacttatattcgagtaccgtcggtaggaacgggtcctattcccgacccgtctacccgaggaacgaacctaacgttacccgacgtccaacgacggtctagtactcgtaggaactaaagtacgaacgacgtccgtagacggacgtccgtagggacggacggtaccgggtcttaggttacgttaacgttacgtacgggtaggttaaaccggttaaaagttaccgttttaagtaaggttaagggtaacgggggttaccggttaaccgggggttaaccgggggttccgttttaaccgg

SEQ ID NO: 409817 - DNA, 632 bp, Homo sapiens
  misc_feature: GZ8MTXP01BFYF8.11.71.G05.1.454.CMB.2.raw
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacagcctctgcttcaccttcattacctatggcatgcacgtgggtccgccagcctccgaggcgagggggctggagtgggtgctagttattcatagtgataggaaatgtgtacttctattcgagtaccgtccgtagaacgggtccgaatttccacccgtctcccaaggacaacctaacgttacccgacgggtaccaaccgaacggtccttaggtaaacttccgtaggggaacctaaaagttcggaaaccagacccgttaggaggaacggtcgtagggaacggtaacgaccgggtcttaggttacgttaacgttacgtaggtaacgttaacgttaaagttatttaacgtaagtaacggtagggtacggttacgggttaacggggttcgttaacg

SEQ ID NO: 409818 - DNA, 598 bp, Homo sapiens
  misc_feature: GZ8MTXP01DVUBM.11.71.G05.1.454.CMB.2.raw
  modified_base (251)..(251): a, c, t, g, unknown or other
  modified_base (269)..(269): a, c, t, g, unknown or other
  modified_base (278)..(278): a, c, t, g, unknown or other
  modified_base (298)..(298): a, c, t, g, unknown or other
tcagcgagagataccacgaccggtgctcgatttagtgtcgtcgcaagagagaggagccccagcactagaagtcggcggtgtttccattcggtgatcagcactgaacacagaggactcaccatggagtttgggctgagtcttgggttttcctcgttgcttcttttaagaggtgtccagtgtcaggtgcaactggaggagtcgtgggggagcgtggtccagccgtgggacgtccctgagtactctcctgtacngcctctgtcttcaccttnattacctangcatgactacgtcggtcccncagacctccgaggcgagggggctagggaggtggggtagctagtttatttcaattagtgaagtaggtaaaatgtacgtactttactaattcgagtaccctccgggtagaacgggcctattccaccgtctaccgagacgacaataccgaggccacgacgtctagtactccgtaggaactaaagtacgaaccagcctaggacgaagcgtaaggacgtacgcggtcttggttagttattacgtagtgaaacgttaagttatttcaaagtggtacggtaggacggttaacggggttcgtttaacg

SEQ ID NO: 409819 - DNA, 753 bp, Homo sapiens
  misc_feature: GZ8MTXP01EP45P.11.71.G05.1.454.CMB.2.raw
  modified_base (310)..(310): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccagccgtgggagtccctgagactctcctgtacagcctctggctcaccttcattacctatggcatgcacgtcgggtcccnccagacctccgagggccgaggggggctggggaggtgggggtagggtctaaggtttattttacgaattagtaggtaaaattagggggtaaaactttagggttagtaaccctttttaccgtttaaattttcccgaaacgggtaaacccgtttccccgggtagggtaaacgggggtccccggtaatttacccgtaaccccggtttacctaccccgaagggtaacgaaacctaaacgtttaccccgaaggggtacccaaaccggaaccgttccgtttacggttaaacttcccgttaggaacccgtaaaattacgaaaccgaacggtcccttagggaacggaaggtccgttagggaacgggaaaccgaaccggggtcttagggtttggttaactttaaccgtggtaacggtaccggtaaaaggttacttttaacgttaaggtaagggg

SEQ ID NO: 409820 - DNA, 613 bp, Homo sapiens
  misc_feature: GZ8MTXP01CNG28.11.71.G05.1.454.CMB.2.raw
  modified_base (250)..(250): a, c, t, g, unknown or other
  modified_base (296)..(296): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtggggggaggcgtggtccagccgtgggagtccctgagactctcctgtacngcctctggcttcaccttcattacctatggcatgcacgtcgggtccncagacctccgaggcgagggggctgggaggtgggtgctagtttattcatatgataggaaatgtcgtacttactattcagtacctccggtaggaacgggcctattcccaccgttctaccgagacgactaacgttccgacggccacgacgcttagtactctaggaactaaagtacgaacgacgccgtaggacgaacgcgtagggacggaccgcgggtctggttagttaattacgttagtacggttaacgttaaagttcgtttaacgtagttaacggtagggttacggttacgggttaaccggggggttcttttaaccggg

SEQ ID NO: 409821 - DNA, 527 bp, Homo sapiens
  misc_feature: GZ8MTXP01AT9CQ.11.71.G05.1.454.CMB.2.raw
  modified_base (423)..(423): a, c, t, g, unknown or other
  modified_base (487)..(487): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctcctgtacagcctctggcttcaccttcattacctatggcatgcacgtgggtccgccagactccaggccagggggctgggagtgggtgctagttattcatatgactggaaatgtgacttctattcagactccgtgaacgggccgattccaccgtctccagacgacaattccaggcacacgctgtatcnggacaaagtgaacagcctgagagctgaggacaggctgttgtacttacgtgtgacgttaaagttntttcgtagtaaggaggtggacgtaacgggggttcgtttcg

SEQ ID NO: 409822 - DNA, 591 bp, Homo sapiens
  misc_feature: GZ8MTXP01BAYZZ.11.71.G05.1.454.CMB.2.raw
  modified_base (292)..(292): a, c, t, g, unknown or other
  modified_base (496)..(496): a, c, t, g, unknown or other
  modified_base (541)..(541): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagcctgggagtccctgagactctcctgtacagcctctggcttcaccttcattacctatggcatgcacgtcgggtccncagacctccgaggcgagggggctgggagtggggtgctagtttattcatatgaagtaggaaattagtgtactttacgtattcagtactccgggtaggaacgggtcgtattccgaccgtctaccgagagaactattacccgagacacgacgctgtactctaggactaaagtcgaaacacgcctagacgagtccgtaggaacggacncgggtctggttagttaacttcgtaggtacgttaacgttaaagttntttaacgaagtaaggtagggttacgacgggttaacggggttcgtttaacg

SEQ ID NO: 409823 - DNA, 586 bp, Homo sapiens
  misc_feature: GZ8MTXP01DKUQ3.11.71.G05.1.454.CMB.2.raw
  modified_base (292)..(292): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtggggggaggcgtggtccagcctgggagtccctgagactctcctgtacagcctctggcttcaccttcattacctatggcatgcacgtgggtcccncagacctccgaggcgagggggctgggaggtgggtgctagttatttcatatgatgggaaatgtgtactttctattcagtacctccggtagaacggggcctattccaccgtctaccagacgactaatccaggcacacgctgtatctaggactaaatacgaacagccctaggagacgcgtaggaacggaccgacgggtcttaggttggttaattaccgtaggtacgttaacgttaaagttactttaacgtaagtaaggtagggtacggttaacgggttcgggggttcgtttaaccgg

SEQ ID NO: 409824 - DNA, 583 bp, Homo sapiens
  misc_feature: GZ8MTXP01ANATT.11.71.G05.1.454.CMB.2.raw
  modified_base (252)..(252): a, c, t, g, unknown or other
  modified_base (280)..(280): a, c, t, g, unknown or other
  modified_base (300)..(300): a, c, t, g, unknown or other
  modified_base (364)..(364): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtggggggaggcgtggtccaggccgtgggaggtccctgagactctcctgtacngcctctggtcttcaccttcattacctanggcatgcacgtcgggtcccnccagacctccgaggcgagggggctgggaggtgggtgactagttattcatatgataggaaatgtntacttatattcagtactcgtaggaacggcctattccacctctacagacgactaatccgaggtacacgacgtctagtacgtctagggactaaagtcgaaacacgcctaggagacgcgtagggacgacgacggtcttagttgttaacttcgtacgtaggaacgttaagttatttaacgagttaaggagggtggttacgggtaacgggggttcgtttaacgg

SEQ ID NO: 409825 - DNA, 544 bp, Homo sapiens
  misc_feature: GZ8MTXP01BC2JQ.11.71.G05.1.454.CMB.2.raw
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggaggagtcgtgggggaggcgtggtccagcctggggagtccctgagactctcctgtacagcctctggctcaccttcattacctatggcatgcactgggtccgccagactccaggcgaggggggctgggaggtggggtggctaggtttatttcatatgaattggaatgtgactttcgtattcagtactccgtgaagggccattcaccgtctccagacgacaattccagcacgacgctgtactctgacctaaatgaaacagcctgacgaagcttggacggcgacgggtcttggttgttattaactggtaacgcgaaaggttactttaacgttaagtaaggg

SEQ ID NO: 409826 - DNA, 699 bp, Homo sapiens
  misc_feature: GZ8MTXP01BVKQX.11.71.G05.1.454.CMB.2.raw
  modified_base (262)..(262): a, c, t, g, unknown or other
  modified_base (267)..(267): a, c, t, g, unknown or other
  modified_base (304)..(304): a, c, t, g, unknown or other
  modified_base (352)..(352): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagtcgttgggttttcctcgttgcttcttttaagaggtgtccagtgtcaggtgcaacgtggaggagtcgtgggggagcgtggtccagccgtgggacgtccctgagactctcctgtacngcctntggcttcaccttcataccatgcatgcactgggtcccnccagacctcgaggcgagggggctggaggtgggtgctagttattcatangataggaaattgtagtactttctattacgacgtacctccgggtaggaaacgggtcccgtacttccgaaccggttcctaccgaagaacggtaaaccctaaacgtttaccccgaacggggtaccaaccgaccggtacgttacggttaacttacgttacggaaaccctaaaagttacgaaaaccgtaccgggacccttacgggaaggacgtaccggtagggaacgggaaccgtaacgggttccgttaggttaccgttaaagtttaccgttggttacggaccgttaaaaggttactttaacgtaaggttaagggttacgggttaacgggttaacgggtttaacccgggggg

SEQ ID NO: 409827 - DNA, 696 bp, Homo sapiens
  misc_feature: GZ8MTXP01A9P1O.11.71.G05.1.454.CMB.2.raw
  modified_base (249)..(249): a, c, t, g, unknown or other
  modified_base (293)..(293): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtggggggagcgtggtccagccgtgggacgtcctgacgtactctcctgtacngcctctgcttcaccttcattaccatgcatcgcacgtcgggcccnccagcctccgaggcgagggggtctgggacggtggggtgtcttaaggtttattcgaagtagtaggtaacgttacgggtaaaattcggtagttacctttaacttaagtttccgaacggttaacccgttaccgggtagggaaacgggttcccgtaagtttacccgacccgttctacccgaagtaaccgtaaaccttaacgttacccgaggtacctaaccgtacggtcttaggttactaccgtaggtaaactaaagttacgaaacccgagtaccgtagaacggacgtcgtacgggacgacgtaacggtcttagttagttaacttgtaggtaacgaacgttaaaagttcgtttaagtaggtaacgggtacgggtacggttaccgggttaacgggggttccgtttaagg

SEQ ID NO: 409828 - DNA, 606 bp, Homo sapiens
  misc_feature: GZ8MTXP01AP5DU.11.71.G05.1.454.CMB.2.raw
  modified_base (249)..(249): a, c, t, g, unknown or other
  modified_base (281)..(281): a, c, t, g, unknown or other
  modified_base (284)..(284): a, c, t, g, unknown or other
  modified_base (298)..(298): a, c, t, g, unknown or other
  modified_base (305)..(305): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtgggttttcctcgttagcttcttttaagaggtgtccagtgtcaggtgcaacgtggaggagtcgtgggggagcgtggtccagccgtgggagtccctgagactctcctgtacncgtcctcgtcgtcttctaccttcacttactgngcntcgctcgtcggccncacgccncgaggcggaggggcgtgggtggtggtgtacttagtttattcatagtagtacgtaggtaaatgtacgtacttactatcgacgtacgtacggtaggacggtctacttccgtaccgtctacgacgaacgtactacgtaccgacgacacgacgtcgtagtactacgtacgaactaaagtacgaacgacgacgtagacgacgcgtacggacggacggacggtcgtcgttagttacgttacgtacgtagttagttaacgttagttaagtagtaaggtaggtacggttacgggtaacgggttcggtcg

SEQ ID NO: 409829 - DNA, 612 bp, Homo sapiens
  misc_feature: GZ8MTXP01A5OFV.11.71.G05.1.454.CMB.2.raw
  modified_base (300)..(300): a, c, t, g, unknown or other
  modified_base (421)..(421): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagccgtgggacgtccctgacgactctcctgtacacgcctctggccttcacccttcattaccctatcggcatgcacgtcgggtcccncagacctccgaggcgagggggctggaggtggggtgctagttattcatagtgactaggaaatagtgtacttacttatcgacgtacgtccgtaggaacgggtccattcccaccgtctccaganacattaccaggtcacgcgactgtaactcctaggggacctaaatcgaaacgagtcccaggaagacgtccgtaggaacggtaccgaacgggtctagggttagttaacgttacggtggttaacgacggttaaagttacctttaagtaggtaaggtacggggtcgttaaacgggtcgggggttcctttaaccggg

SEQ ID NO: 409830 - DNA, 559 bp, Homo sapiens
  misc_feature: GZ8MTXP01A4ONT.11.71.G05.1.454.CMB.2.raw
  modified_base (467)..(467): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagccgtgggagtccctgagactctcctgtacagtcctctggccttcaccttcattaccctatggcatgcacgtggtcccgccagactccgaggcgagggggctgggagtgggtgctagttattcatatgataggtaaatgtgacttatattcagtactccgtaggaacggccattccacgtctccagacgacatccgagtcacacgctgtatcaggactaaatcgaacagcctaggacgagctaggacggacncgggcttggttggttacttacgtaggtggttacgttaagttatttaacgtagtaaggtagggtagttacggtaacgggggttcgtttaacgg

SEQ ID NO: 409831 - DNA, 675 bp, Homo sapiens
  misc_feature: GZ8MTXP01B6668.11.71.G05.1.454.CMB.2.raw
  modified_base (147)..(147): a, c, t, g, unknown or other
  modified_base (245)..(245): a, c, t, g, unknown or other
  modified_base (264)..(264): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggtttccncgttagctctttaagaggtgtccagtgtcaggtgcaacgtggaggagtcgtgggggagcgtggtccagccgtgggagtccctgagactctcctgtacngcctctggcttcacccttnattacctatggcatgcacgtcggtccgcagacctccgaggcgagggggctgggagtggggtggctagttatttcatagtgtataggaaaatgtcgactttacgtaattcgagtaaccgtccggtagaaacggggtccgaatttcccgaacccgtctacccgaagtacggaacttaacgttacccgaagggtacccaacgtacccgtcgttacgttacgttaccgtacggaaacgtaaacggtacgaaaccgtacgacccgtaggaacggtacggtacggtacgggaaacggtaccggaggtaacgttaggttacgtttaacgttacgtaggtaacgttaacggttaaagttcgtttaagtaaggttaagggtacgggttacgggttaccgggttaacggggttccgtttcg

SEQ ID NO: 409832 - DNA, 553 bp, Homo sapiens
  misc_feature: GZ8MTXP01CKSEJ.11.71.G05.1.454.CMB.2.raw
  modified_base (290)..(290): a, c, t, g, unknown or other
  modified_base (526)..(526): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacagcctctggcttcaccttcattacctatggcatgcacgtgggtcccncagcctcccgaggcgaggggggctgggaggtggggtgctagttatttcatatgactggaaatgtgacttactattcagtactccggtagaacgggcctattccaccgtctaccagagacaattccaggcacacgctagtactcgtaggactaaagtcgaaacagcctgagacgcgtaggacggaccacgggtctggttgtattcgtagttgacgttaagttatttaacagttaagnggtacggacggttaacgggggctttcg

SEQ ID NO: 409833 - DNA, 578 bp, Homo sapiens
  misc_feature: GZ8MTXP01BCZL1.11.71.G05.1.454.CMB.2.raw
  modified_base (249)..(249): a, c, t, g, unknown or other
  modified_base (267)..(267): a, c, t, g, unknown or other
  modified_base (276)..(276): a, c, t, g, unknown or other
  modified_base (293)..(293): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccaggcctggggagtccctgacgactctcctgtacngcctctggcttcaccttnattacctanggcatgcacgtggcccncagactccgaggcgagggggctgggacggtggggtgctaggtttattcatatggactggaaaatgtacgacttacattcagtcctaccggtagaacgggcctattccaccgtctaccagacgacaagttccgacggacacgacgtctagtactcgtacggactaaatcgaacacgccgtagacggagcgtaggacggacgtcggcttgttagttacttcgtgtacgacgttaagttacttaacgtaagtggtacggtggacgggttaacggggttcgtttaacgg

SEQ ID NO: 409834 - DNA, 523 bp, Homo sapiens
  misc_feature: GZ8MTXP01B96Z3.11.71.G05.1.454.CMB.2.raw
  modified_base (306)..(306): a, c, t, g, unknown or other
  modified_base (351)..(351): a, c, t, g, unknown or other
  modified_base (505)..(505): a, c, t, g, unknown or other
tcagcgagagataccacgaccggtgctcgatttagtgtcgtcgcaagagagaggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggagtccctgagactctcctgtacagcctctggctcaccttcattaccatggcatgcacgtggtccncagactccgaggcgagggggctggagtggtgctagttattcatangaataggaatgtgacttcgtattcagacctcgtagacggcgattcacgtctcagacgacaatccagcacgcgctgtatctgacaaagtagaactagcctaggagaacgcttggacgacgacggtcttgttgttacttctgtaagacgaaagttntttaacgttaagtaaggg

SEQ ID NO: 409835 - DNA, 548 bp, Homo sapiens
  misc_feature: GZ8MTXP01ESBUZ.11.71.G05.1.454.CMB.2.raw
  modified_base (305)..(305): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcgtgggttttcctcgttgctcttttaagaggtgtccagtgtcaggtgcaactggaggagtcgtgggggagcgtggtccagcctggggagtccctgagactctcctgtacagcctctggctcaccttcattacctatgcatgcacgtggtccnccagactccgaggcgagggggctgggagtggggtgctagtttatttacatatgaatagggaaatgtagacttctattcagtactccgtgaacggcgtattcaccgtctccagacgactaatccaggcacgacgtctagtatcgtgacaaatcgaactagcctagagaacgtcgaggacggacgacggtcttgttcgttacgttaagtggtaacgaacgtaagttactttaacgttaagtaagg

SEQ ID NO: 409836 - DNA, 624 bp, Homo sapiens
  misc_feature: GZ8MTXP01AUBZR.11.71.G05.1.454.CMB.2.raw
  modified_base (253)..(253): a, c, t, g, unknown or other
  modified_base (282)..(282): a, c, t, g, unknown or other
  modified_base (303)..(303): a, c, t, g, unknown or other
  modified_base (348)..(348): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggaggaggtcgtggggggaggcggtggtccgagccgtgggaggtccctgagacctctcctgtacngcctcgtggcttcaccttcattacctagnggcatgcctacgtcgggtccnccagacctccgaggcgagggggctgggagtgggtgctagttattnatatgataggaaatgtgtacttatattcgacgtacgtccggtaggaacggggtcctacttccgacccgttctacccgaaggtacgaactaacttcccgaaggacccaacgtaccgtcttaggtacttccgtaggggaactaaagtacgaaacgtacgccgtaaggagaacgcggtaagggacggtacgaggtctggttatcttagtggtacgagttaaagttctttaacgtagtaagggtacgggtgttaccgggttaagggggttctttaacggg

SEQ ID NO: 409837 - DNA, 623 bp, Homo sapiens
  misc_feature: GZ8MTXP01BH8KI.11.71.G05.1.454.CMB.2.raw
  modified_base (262)..(262): a, c, t, g, unknown or other
  modified_base (276)..(276): a, c, t, g, unknown or other
  modified_base (312)..(312): a, c, t, g, unknown or other
  modified_base (478)..(478): a, c, t, g, unknown or other
  modified_base (485)..(485): a, c, t, g, unknown or other
  modified_base (537)..(537): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggtttcctcgttgcttcttttaagaggtgtccagtgtcaggtgcaacgtggaggagtcggtggggggaggcgtggtccaggccgtggggacggtccctgacgacctctcctgtacagtccctntgccttcacccttnacttacctatcggacagtgcctacgtcggggtcccnccgagacctccgagggtccgaggggggtctgggagggtgggtgtactagtttattcaattagtaggtagtacgggtaaatcggtatactttacaattcgagtaccgtcggtagggaacggccgtattcccgacctcgtaccagacgactaactccgagacacgccntgtatcnggtacaaacgtcgaacacgtccgtagagacgtcgtaggacggacgtcgggtntggttagtacgttaggtagtacgttaacgttagttacgttaagtaggtaacggtagggtacggttacggggttcgggttcgttcgg

SEQ ID NO: 409838 - DNA, 546 bp, Homo sapiens
  misc_feature: GZ8MTXP01C0EY5.11.71.G05.1.454.CMB.2.raw
  modified_base (268)..(268): a, c, t, g, unknown or other
  modified_base (314)..(314): a, c, t, g, unknown or other
  modified_base (359)..(359): a, c, t, g, unknown or other
  modified_base (434)..(434): a, c, t, g, unknown or other
  modified_base (440)..(440): a, c, t, g, unknown or other
  modified_base (458)..(458): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtgggaggagtcgtggggggaggcgtggtccaggcctggggagtccctgagctctcctgtacngcctctggctcaccttcattacctatggcatgcacgtcgggtcccnccagacctccgaggcgagggggctgggagtgggtgctagttattnatatgaattgaatgtgtacttctatcagactcgtagacggctatcacgtctaccagacgacatccaggcacgacnctgtanctgacaaatacgaacacncctgagaagcgttaggacggaccgaacgggtcttagttgttactttaagtggtgtaacggtaaagttattttaacgttaagttaaggg

SEQ ID NO: 409839 - DNA, 654 bp, Homo sapiens
  misc_feature: GZ8MTXP01EFV9S.11.71.G05.1.454.CMB.2.raw
  modified_base (253)..(253): a, c, t, g, unknown or other
  modified_base (301)..(301): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtggggggagcgtggtccaggccgtggggacgtccctgacgactctcctgtacncgcctctggtcttcaccttcattacctatggcatgcacgtcgggcccncagacctccgaggcgagggggctgggaggtgggtgctaggtttatttcaattagtagtaatagggtaaatggtatacctttacttattcgaagtaacccgttccggtaggaaacggggtccctattccctaccgtctaccgaagacgaactaacttaccgacgaccacgacgctagtactctacggaactaaagtacgaaacgacgtccgtagaagacgtcgtacgggaacggtacgcgggtaacgttaggttagttaacgttacgtaggtaacggttaacgttaaaacgttagtttaacgtaagttaagggtacgggtacggttacgggttaacgggggttcgtttaaccgg

SEQ ID NO: 409840 - DNA, 612 bp, Homo sapiens
  misc_feature: GZ8MTXP01BDTJ0.11.71.G05.1.454.CMB.2.raw
  modified_base (247)..(247): a, c, t, g, unknown or other
  modified_base (295)..(295): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccaggccgtgggagtccctgacgactctctgtacngcctctggccttcaccttcattacctagtggcatgcacgtcgggtccnccagacctccgaggcgagggggctggaggtgggtgctagtttatttcagtagtgtagtagggtaaactgtcgactttcgtattcgagtaccgtaccgtagggaacgggtcctagttcccaccgtctaccagactaaccaattccgacggacacgacgtctcgtatcttaggactaaagtacgaacgacgtaccgtagagacgcgtaggacgtaccgcggtcgtggttcgtattaccgtggtacgaacgttaaagttacgtttaagtaggtaagggttagggtggttaacccgggtaacgggggttcgtttaaccggg

SEQ ID NO: 409841 - DNA, 590 bp, Homo sapiens
  misc_feature: GZ8MTXP01DQH2Z.11.71.G05.1.454.CMB.2.raw
  modified_base (247)..(247): a, c, t, g, unknown or other
  modified_base (252)..(252): a, c, t, g, unknown or other
  modified_base (290)..(290): a, c, t, g, unknown or other
  modified_base (461)..(461): a, c, t, g, unknown or other
  modified_base (473)..(473): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagcctgggagtccctgagactctcctgtacngcctntgcttcaccttcattacctatggcatgcacgtggtccncagactccgaggcgagggggctggaggtgggtggctagtttatttcatagtgataggtaaatgtgtacttctattcgagtaccgtccgtaggaacgggtcctaattcccaccgtctccgaagacgactaacgttccaggcacacgctgtactctaggaacaaatacgaacncgcctgagacgngtaggacggaccgacgggtcttaggttagttaacgtttacgtggtacgttaacggttaaattagtttaactaagtaaggagggtcggttaacggttaacgggggttcgttttaacgg

SEQ ID NO: 409842 - DNA, 613 bp, Homo sapiens
  misc_feature: GZ8MTXP01DP18R.11.71.G05.1.454.CMB.2.raw
  modified_base (247)..(247): a, c, t, g, unknown or other
  modified_base (293)..(293): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccaggcctgggagtccctgagactctcctgtacngcctctggtcttcaccttcattacctatggcatgcacgtgggtccncagacctccgaggcgagggggctgggagtgggtgctagtttatttcatatgatggaaatgtgactttctaattcgagtaccgtccgtaggaaacggggtcctatttccacccgttctaccgaagaagaactaacttaccgaggcacacgctgtaactccgtaggaacctaaatacgaaacaacgcccgtagacgaagtccgtaggacggaccgaacggtcttaggttagtaacgtttacgaggttgaacgttaaagttagttttaacgtaaagtaacgggtaggtacggttaccggttaacgggggttcgttttaaccgg

SEQ ID NO: 409843 - DNA, 554 bp, Homo sapiens
  misc_feature: GZ8MTXP01EJSNW.11.71.G05.1.454.CMB.2.raw
  modified_base (267)..(267): a, c, t, g, unknown or other
  modified_base (311)..(311): a, c, t, g, unknown or other
  modified_base (351)..(351): a, c, t, g, unknown or other
  modified_base (354)..(354): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtgggaggagtcgtgggggagcgtggtccagccgtgggagtccctgacgactctcctgtacngcctctggctcacttcattacctatggcatcgcacgtcggtccncacgactccgaggcgagggggctggagtgggtgctagttnttnatatgaataggaatgtgtacttctattcagtactcgtagacggctatcacgtctaccagacgacactcagccacgcgtctgtactctcgacaaatacgaactacgcctaggagaaggtcgttaggacggacgacggtcttaggttagttacttaacgtggtaacgtaaggtaaagttagttttaacgttaagttaagggg

SEQ ID NO: 409844 - DNA, 577 bp, Homo sapiens
  misc_feature: GZ8MTXP01BR2Y3.11.71.G05.1.454.CMB.2.raw
  modified_base (242)..(242): a, c, t, g, unknown or other
  modified_base (261)..(262): a, c, t, g, unknown or other
  modified_base (265)..(265): a, c, t, g, unknown or other
  modified_base (269)..(269): a, c, t, g, unknown or other
  modified_base (278)..(278): a, c, t, g, unknown or other
  modified_base (283)..(283): a, c, t, g, unknown or other
  modified_base (292)..(292): a, c, t, g, unknown or other
  modified_base (302)..(302): a, c, t, g, unknown or other
  modified_base (311)..(311): a, c, t, g, unknown or other
  modified_base (317)..(317): a, c, t, g, unknown or other
  modified_base (338)..(338): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggtttcctcgttgctctttaagaggtgtccagtgtcaggtgcaactggaggagtcgtggggggagcgtggtccagcctgggagtccctgagactctctgtacngcctctgctcactcatacnngcntgcncgtcggccncagcncgaggcggnggggcgtggnggtgggtgntagttnttcatgtgactaggtaatgtntacttctatcgacgtcgtcgaggacggctatccactcacagacactactaccgagacacgacgtctagtactacgtacggtaactaaacgtcgaaaccgtcgtccgtagacggacgacgtacggacggaccgtacggtcgttaggttacgttacgttacgtacggtacgttaacggttaacgttacgttaagttagtaacggtacgggtacgggttacgggtaaccggggttcggttcg

SEQ ID NO: 409845 - DNA, 776 bp, Homo sapiens
  misc_feature: GZ8MTXP01CWG20.11.71.G05.1.454.CMB.2.raw
  modified_base (273)..(273): a, c, t, g, unknown or other
  modified_base (290)..(290): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggagtccctgagactctcctgtacagcctctggcttcaccttcattacctanggcatgcacgtcggccnccagacctcgaggcgagggggctgggacgggtggggtggtacgtaggttttatttacgaagttagttaggtaacgttaaggggtaaaatttaggttacggttaacccttttaacgttaacttttaacccgaagggtaccccgttacccggggttaaggaaaccgggggtccccttaaagttaccccgtaccccgttccgtaccccgaaggtaacgtaaacctaaccttacccgaaacgggaccaaccgtaaccggtccttaggttaacttacccgttaggggtaactaaaaacgttaccggaaaccgtacggtaccccgtaggaacggacggtaccgtaggggaaccgggaaccgtccggggtaagttcgggttaggtttaacgttaccgttagggttacggttaaccggttaaagttacgttttaacgtaagtaagggtacggggttacggttaccggggttaacgggggttcgttttaaccggg

SEQ ID NO: 409846 - DNA, 618 bp, Homo sapiens
  misc_feature: GZ8MTXP01C4QBA.11.71.G05.1.454.CMB.2.raw
  modified_base (266)..(266): a, c, t, g, unknown or other
  modified_base (314)..(314): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtgggaggagtcgtggggggagcgtggtccagcctggggagtccctgagactctcctgtacngcctcgtggccttcaccttcaattacctatggcatgcacgtcggtccnccagcctccgaggcgagggggctgggaggtggggtgctagtttattcatagtcgaaagtaggtaatgtgtactttctattcgaagtaccgtccggtagacgggccgtattccgacccgtctaccgagacgaactaacttcgacggtaccacgaaccgtcttacgtactactacgactaaacgtacgaaccgagtaccgtaggaacggaacgtcgttagggacggaaccggtaccgggtcttaggttcgttaacgttaacgtaggtaacggaacgtaaggttacctttaagttaaggttaagggg

SEQ ID NO: 409847 - DNA, 576 bp, Homo sapiens
  misc_feature: GZ8MTXP01AFZDT.11.71.G05.1.454.CMB.2.raw
  modified_base (248)..(248): a, c, t, g, unknown or other
  modified_base (253)..(253): a, c, t, g, unknown or other
  modified_base (271)..(272): a, c, t, g, unknown or other
  modified_base (289)..(289): a, c, t, g, unknown or other
  modified_base (321)..(321): a, c, t, g, unknown or other
  modified_base (352)..(352): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaaacgtggaggagtcgtggggggagcgtggtccagccgtgggagtccctgagctctctgtacngcctntgcttcacttcattaccnngcatgcacgtgggtccncagctccgaggcgagggggctgggaggtgggngtctagtttattcatagtgataggaaatgtnactttactattcgacgtacgttccggagtaacggggcctattcccaccgtctaccagacacactaccaggcacacgtctgtactcacgggtaacaagtacgaacgtacgccgtagagacgtcgtaggaacggacgcgggtaattgttacgtacttacgtagtagaacgttaaagttctttaacaaagtggaggtacgttacgggttaacggggttctttaacgg

SEQ ID NO: 409848 - DNA, 608 bp, Homo sapiens
  misc_feature: GZ8MTXP01B9LW0.11.71.G05.1.454.CMB.2.raw
  modified_base (256)..(256): a, c, t, g, unknown or other
  modified_base (261)..(261): a, c, t, g, unknown or other
  modified_base (307)..(307): a, c, t, g, unknown or other
  modified_base (333)..(333): a, c, t, g, unknown or other
  modified_base (350)..(350): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggaggtcggtggggggaggcgtggtccaggccgtggggacgtccctgacgactctcctgtacngcctntggtcttcaccttcacttacctagtggcatcgcacgtcgggtcccncagcctccgaggcgagggggctgggngtgggtgctagttattnatgtagataggaaatgtagtacttatactcagctcggtagacgggtctacttccaccgtctccaagtacgaactaacgttccgaacggcaacgacggtctaggtactcgagactaaagtcgaaacagccgtagagtacgtcgtaggaacggaccgcgggtaactggttagttacgttcgtaggtacgttaacgttaaagttctttaaggtaaggtaaggtaggggtacgttacggggtcgggggttccgtttaacggg

SEQ ID NO: 409849 - DNA, 731 bp, Homo sapiens
  misc_feature: GZ8MTXP01DESUG.11.71.G05.1.454.CMB.2.raw
  modified_base (250)..(250): a, c, t, g, unknown or other
  modified_base (255)..(255): a, c, t, g, unknown or other
  modified_base (268)..(268): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggaggcgtggtccagccgtgggagtccctgacgactctcctgtacngcctntcgcttcaccttnacttacctatggcatcgactacgtcgggacccgacacgacctaccgaggcggaggggggtctagggggacggtgggggtcggtactaggttttatttcgaattagtaggtaactagggtaaaactggttacgtacctttcttaaattcccgaaaggtaacccgttaccgggttaggggaaaaccgggtcccgtaacgttaccccgtaacccggttacctaccgaaacgggtaaactaaaccgttaaaaccgttcccgaacgggtacctaacccgtaaccggtcttacggtaacttacccgttagggaaaccctaaagtaacggaaaccacggtaccgtaagacggtaacgtcgtacgggaaacgggcctaaacgggtcttaggttaggttacttacgtggtaagaacggttaattactttaagaagtggtagggtacgttacgggtcggggttcgtttaacgg

SEQ ID NO: 409850 - DNA, 666 bp, Homo sapiens
  misc_feature: GZ8MTXP01AI2PE.11.71.G05.1.454.CMB.2.raw
  modified_base (250)..(250): a, c, t, g, unknown or other
  modified_base (255)..(255): a, c, t, g, unknown or other
  modified_base (267)..(267): a, c, t, g, unknown or other
  modified_base (276)..(276): a, c, t, g, unknown or other
  modified_base (297)..(297): a, c, t, g, unknown or other
  modified_base (507)..(507): a, c, t, g, unknown or other
  modified_base (552)..(552): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaaggaggtgtccagtgtcaggtgcaacgtggaggagtcgtgggggagcgtggtccagccgtgggacgtccctgagactctcctgtacngcctntgcttcaccttnattacctanggcatcgcacgtcgggtcccncagacctccgaggcggagggggtctaggggacggtgggggtgtacttaggttttattcaattagtaggtattagggaaattggtcgtactttactattcgagtcccgtacggtaggaacgggtcctattcccgaccgtctaccgagacgaactaacttaccgagtccaacgaccgcttagtacttcgacgggtaacaaagttcgaaacgngtcccgtagaacgtacggcgtaagggaccggacgtaccgggggtnttgggttacgttaacgtttacgtacggtaacgttaacggttaaagtttactttaacggaggttaacgggtacgggtaccgggttaccggggttaaccgggggttcgtttaacgg

SEQ ID NO: 409851 - DNA, 636 bp, Homo sapiens
  misc_feature: GZ8MTXP01EFRX1.11.71.G05.1.454.CMB.2.raw
  modified_base (249)..(249): a, c, t, g, unknown or other
  modified_base (254)..(254): a, c, t, g, unknown or other
  modified_base (294)..(294): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgctcttttaagaggtgtccagtgtcaggtgcaacgtggaggagtcgtgggggaggcgtggtccagcctggggacgtccctgagactctcctgtacngcctntggcttcaccttcattacctatggcatgcacgtgggtccnccagacctccgaggcgagggggctggaggtgggtgtctagttatttcatagtgtaagtaggaaaacttggtgtactttactaattcgacgtaccgtccgggtaggaacgggtcctattccacccgtctaccgagacgaactaacttaccgaggtaccaccacgtacctagtattaccgtacggaactaaaagtacgaaacacgaccgtgaacgacgcgtaggacggaccgtacggtcttaggttagttaacgtttacgtaggtaacgttaacggttaaagttacgtttaagttaagtaaggtagggtacggttacggttaaccgggggttcgttttaaccgg

SEQ ID NO: 409852 - DNA, 694 bp, Homo sapiens
  misc_feature: GZ8MTXP01EMSBN.11.71.G05.1.454.CMB.2.raw
  modified_base (244)..(244): a, c, t, g, unknown or other
  modified_base (249)..(249): a, c, t, g, unknown or other
  modified_base (290)..(290): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacngcctntggcttcaccttcattacctatggcatgcacgtgggtcccncagacctccgaggcgagggggctgggaggtgggtgtctaggtttatttcagttatgtaagtgggaaaattggtgtacctttctaatttcgaggtaaccgtcccggtaggaaacggggtcccgtattttcccgaacccggttctacccgaaggaacgtaacctaaactttacccggaacggtaccaaccgaacgtccttaggttaacttccgttacggggaacctaaaattcggaaaaccgtacggtaccccgttaggaggaacgtccgtagggaacggaaccgtaacggggtccttagggttagttaaacgtttacgtaggttaacggaacgttaaagttactttaaccgtaagtaacgggtagggttacggaacgggttaaccgggggttcgttttaaccggg

SEQ ID NO: 409853 - DNA, 572 bp, Homo sapiens
  misc_feature: GZ8MTXP01ANCG8.11.71.G05.1.454.CMB.2.raw
  modified_base (201)..(201): a, c, t, g, unknown or other
  modified_base (265)..(265): a, c, t, g, unknown or other
  modified_base (270)..(270): a, c, t, g, unknown or other
  modified_base (310)..(310): a, c, t, g, unknown or other
  modified_base (484)..(484): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtncaactggaggagtcgtgggggagcgtggtccagccgtgggacgtccctgacgctctcctgtacngcctntggcctcaccttcattacctatggcatgccacgtggtccnccaggcctccgaggcgagggggtctgggagtggggtcgctagtttattcatatcgaataggaatgtgtacttctattcagtacctcgtagacgggcctattccaccgtctaccagtacgacactcaagccaacgacgtctacgtactctagacaaagtacgaaactacggaccngggaacgaagccgttgggacgacgaccgggtcttggttgtttacgttaagtggtaacgtaacgtaagttactttaacgttaagtaagg

SEQ ID NO: 409854 - DNA, 682 bp, Homo sapiens
  misc_feature: GZ8MTXP01AE6IF.11.71.G05.1.454.CMB.2.raw
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggaggtccctgagactctcctgtacagcctctggcttcaccttcattacctatggcatgcacgtgggtcccgcagacctccgaaggcgagggggctgggaggtgggggtggctaggtttatttcattagtagatagggaaattggtgactttcgtaatttcaagtaccttccggtagaacggggtcctatttaccacccggttctaccgagaacggacctaaacgtttacccgaacgggccaacgaacccggtcttaggtaacttctacggggtaactaaaacgttacggaaaacacggacccgtaggacggaagtaccgtagggaacggaaccgaccgggtccttgggttagttacgtttaaccgttggtaacggttaccgggttaaaattacgttttaagtaaggttaagggtaacgggttacgggttaaccgggttaacggggggttccgttttaacggg

SEQ ID NO: 409855 - DNA, 541 bp, Homo sapiens
  misc_feature: GZ8MTXP01B84GN.11.71.G05.1.454.CMB.2.raw
  modified_base (423)..(423): a, c, t, g, unknown or other
  modified_base (430)..(430): a, c, t, g, unknown or other
  modified_base (443)..(443): a, c, t, g, unknown or other
  modified_base (497)..(497): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctcctgtacagcctctggcttcaccttcattaccctatggcatgcacgtgggtccgccagactccgaggcgaggggggctgggagtgggtggctagttattcatatgataggaaatgtgacttctattcagtactccgtagaacgggccgtattccaccgtctccagacgacattccaggcacgacgntgtatcnggacaatcgaacngcctgagagctaggacgacgcggtctggttgtattacgtgtagacgttaagttntttaacagtaaggaggtcgacggtaacgggggttcgtttaacgg

SEQ ID NO: 409856 - DNA, 607 bp, Homo sapiens
  misc_feature: GZ8MTXP01ANNP6.11.71.G05.1.454.CMB.2.raw
  modified_base (294)..(294): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagcctgggagtccctgagactctcctgtacagcctctggcttcacccttcattacctatggcatgcacgtgggtcccnccagacctccgaggcgagggggctgggaggtgggtgctagttattcattatgataggaaatgtagtactttacgtattcagtacctccggtagaacgggtccctattccaccgtctaccagacgacaattaccgaggcacgacgctagtactactaggactaaagtcgaaacgagtaccctaggaacgacgtccgtaggaaccggtaccgacgggtcgttggttagttaacttacgtggtacgttaacgttaaagttactttaacgtagtaacggtacgggtaggttaccggtaacgggggttcgtttaacgg

SEQ ID NO: 409857 - DNA, 670 bp, Homo sapiens
  misc_feature: GZ8MTXP01BTUPY.11.71.G05.1.454.CMB.2.raw
  modified_base (300)..(300): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagcccgtggggacggtccctgacgactctcctgtacagcctctggtcttcaccttcattaccctatggcatgcacgtgggcccnccagacctccgaggcgagggggctgggagtgggtggctagtttatttcatagtgataggaaattagtgtactttctattcaggtaccttccggtggtaacggggccctaattcccgtacccgttctacccgaagacgaaccaacttacccgagggtcacgaacgtccttagtacttccgtaggggactaaaagtcgaaaccgaggtaccccgtagggaaccggaaggtccggtagggaacgggaccgtaccgggtaacttcggttaggttaatttaccgtaggtagttaaccggttaaagttacgttttaacgtaaggttaaggtacgggttacgggttaccgggttaacgggggttcgttttaaccggg

SEQ ID NO: 409858 - DNA, 600 bp, Homo sapiens
  misc_feature: GZ8MTXP01AK6J3.11.71.G05.1.454.CMB.2.raw
  modified_base (264)..(264): a, c, t, g, unknown or other
  modified_base (292)..(292): a, c, t, g, unknown or other
  modified_base (341)..(341): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagcctgggagtccctgagactctcctgtacagcctctggcttcaccttnattacctatggcatgcacgtgggtcccncagacctccgaggcgagggggctgggaggtgggtggctagttattcatntgatggaaatgtgacttctattccgagtaccgtccggtagaacgggccgattccgaccgtctaccgagagacattccaggcacacgctagtatcgtaggactaaagtacgaaaccacgccgtagacgacgcgtaggaacggaccgcgggtaactggttagttaacgttaccgtagtacggttaacggttaaaagttagtttaacgtaagttaaggtaagggtacggttaacgggttaaccgggggttcgtttaaccggg

SEQ ID NO: 409859 - DNA, 687 bp, Homo sapiens
  misc_feature: GZ8MTXP01ASB35.11.71.G05.1.454.CMB.2.raw
  modified_base (250)..(250): a, c, t, g, unknown or other
  modified_base (297)..(297): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggacgtccctgagtactctcctgtacngcctctggcttcacccttcattaccctatggcatgcacgtgggtccncagacctccgaggcgagggggctagggaggtggggtgctagttatttcatatgataggaaatgtcgactttctattcagtacctcggtagaacgggtccctattcccgaccgttctacccgaagtacgaacctaacgttacccgagggacccaacgaccggtcttacggtacttcccgttaggggaaccctaaaagtaccggaaaaccctaggtaccccgttaggaacggtaacggtacccgttaggggaaaccgggtacccgaaccgggtccgttaagggtttacgttaaacgtttaccgtaggttacgttaaccggttaaaagttacttttaacgtaagtaagggtacgggtacggttaacccgggttcgggggttaacgttttcggg

SEQ ID NO: 409860 - DNA, 636 bp, Homo sapiens
  misc_feature: GZ8MTXP01A305D.11.71.G05.1.454.CMB.2.raw
  modified_base (182)..(182): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagnggtgtccagtgtcaggtgcaactggaggagtcgtgggggagcgtggtccagcctgggaggtccctggagactctcctgtacagcctctggctcaccttcattaccatcggcatgcactgggtccgcagacctccgaggcaggggggctgggacgtggggtggctaaggtttatttcgatatgtaaagttgggaattggtgtacctttctaattcaagtaccttccgtaggaaacgggtcccgatttaccgaacccggttctacccgaagacggaacctaaacgttccccgaagggtcccaaccggaaccgtcgttacggtaaacttccgtacggacctaaaaggttacgaaacgtacggcccttaggaaccggaagtccgaggaacgggaccaaccggggcttaggttcgttattaacgtgttaacgacgtaaagttctttcgttaagtaaggg

SEQ ID NO: 409861 - DNA, 649 bp, Homo sapiens
  misc_feature: GZ8MTXP01DVBT7.11.71.G05.1.454.CMB.2.raw
  modified_base (242)..(242): a, c, t, g, unknown or other
  modified_base (247)..(247): a, c, t, g, unknown or other
  modified_base (268)..(268): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggtttcgtcgttaggctctttaagaggtgtcagtgtcaggtgcaatggaggagtcgtgggggagcgtggtccagcctgggagtccctgagactctcctgtacngtctntgtctctactctattactagngcagtcgacgtacgtcggtcccacacgacctccgacggcgggacggggcggtggtaggtgggtggtcgtagtttagtttactatagtagtagtaggtaaagtagtacgtacttaacttacttcgtaacgtaccgtaccggtacggtaacgggtaccgtacgttacctaccgtaccgtacgaacgtaacgtaacgtaacgtaccgacgacgacgacgtacgtagtacttacgtacggtaactaaacgtaacgaacgacgtacgtacgacggtacgtacgtaggacggtacgtacggtcgttgttagttacgttacgtagtagttaacgttaagttagttaagttagtaaggtaggtacggttacgggtaacgggttcgttcg

SEQ ID NO: 409862 - DNA, 578 bp, Homo sapiens
  misc_feature: GZ8MTXP01B7Q58.11.71.G05.1.454.CMB.2.raw
  modified_base (292)..(292): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctcctgtacagcctctggccttcaccttcattaccctatggcatgcacgtgggtccnccagactccgaggcgagggggctgggagtgggtgctagtttattcatatgatggaaatgtgtacttctattcgagtaccgtccggtaggaacgggacctattcccaccgtctaccgagacgaacaattccaggcacacgctgtatctaggactaaagtcgaaacagccctgaacgacggctaggacggacgacgggtctggttcgtaattcgtaggtagttaacggttaaagttactttaacgtaagtaaggtagggtgaaccgggttaacgggggttctttaacg

SEQ ID NO: 409863 - DNA, 592 bp, Homo sapiens
  misc_feature: GZ8MTXP01EK4GM.11.71.G05.1.454.CMB.2.raw
  modified_base (245)..(245): a, c, t, g, unknown or other
  modified_base (271)..(271): a, c, t, g, unknown or other
  modified_base (292)..(292): a, c, t, g, unknown or other
  modified_base (355)..(355): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggaggagtcgtgggggagcgtggtccagcctgggagtccctgagactctcctgtacngcctctgcttcaccttcattacctanggcatcgcacgtcgggtcccnccagcctccgaggcgagggggctgggaggtgggtgctagttatttcatatgataggaaatgtntacttctattcgagtacctccggtagaacgggtcctattccaccgtctccagacgacaacttaccgaggtccacgacgtctagttactctaggaactaaatacgaaacacgcctaggacgacgtacgtacggaacggacgaaccggtcttggttagttacgtttacgtgtaaggaccgttaaagttactttaagtagtaaggtagggtcggttacgggtaacgggggttcgtttcgg

SEQ ID NO: 409864 - DNA, 640 bp, Homo sapiens
  misc_feature: GZ8MTXP01D52CZ.11.71.G05.1.454.CMB.2.raw
  modified_base (277)..(277): a, c, t, g, unknown or other
  modified_base (296)..(296): a, c, t, g, unknown or other
  modified_base (312)..(312): a, c, t, g, unknown or other
  modified_base (361)..(361): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggaggcgtggtccagccgtgggacgtccctgacgtactctcctgtacagcctctgtctcaccttcattacctanggcatgcacgtgggtcccncagacctccgaggcgngggggctgggaggtgggtgctagtttattcatatagataggtaaatgtntaccttctatcgaacgtaccgtccggtagaacggggcctattcccaccgtctacgaagacgtaacctaacgttaccgaggaccacgacgtcgttgtactacttacgggaaactaaagtaacgaaacgtacgacccgtagacggaacggtctagggaaccggtacgaccgggttaactggttacgttaagttacgttggtaaggttaaccgttaaagttactttaacgtaggttaaggtagggtacggttaaccgggttccgggggttcgtttaaccggg

SEQ ID NO: 409865 - DNA, 569 bp, Homo sapiens
  misc_feature: GZ8MTXP01AFG8N.11.71.G05.1.454.CMB.2.raw
  modified_base (249)..(249): a, c, t, g, unknown or other
  modified_base (277)..(277): a, c, t, g, unknown or other
  modified_base (294)..(294): a, c, t, g, unknown or other
  modified_base (487)..(487): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggacgtccctgagactctcctgtacngcctctggtcttcaccttcattacctanggcatgcacgtggtccncagacctcgaggcgagggggctgggagtgggtgctaggtttattcatagtgattaggaaatgtagtactttactattccgagtacctccggagtaacggggccgtacttccaccgttctaccagacgtacaatccgagcacgacgctagtatctgacaaagtgaaactgcctgacgagctggacgacgacggntggttagtagttacgttgagacgttaaaggttctttaacgtagtaaggtgggtacgttacgggtaacggggttcgtttaacg

SEQ ID NO: 409866 - DNA, 517 bp, Homo sapiens
  misc_feature: GZ8MTXP01DX450.11.71.G05.1.454.CMB.2.raw
  modified_base (288)..(288): a, c, t, g, unknown or other
  modified_base (436)..(436): a, c, t, g, unknown or other
  modified_base (452)..(452): a, c, t, g, unknown or other
  modified_base (480)..(480): a, c, t, g, unknown or other
  modified_base (485)..(485): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtggggagcgtggtccagcctgggagtccctgagactctcctgtacagcctctggcttcaccttcattacctatggcatgcactgggtcccncagactccgaggcagggggctggagtgggtgcagttattcatatgatggaaatgtgacttctaattcagacctccgtgaagggccattcaccgtctcagagacaattccaggcacacgctagtatctaggcaaatcgaacagcctganagctgaggcacgggtntgttgttacttcgtgtagacgttaattnttaanagtaagaggtcgttacggtcggggttcgttcg

SEQ ID NO: 409867 - DNA, 608 bp, Homo sapiens
  misc_feature: GZ8MTXP01A928N.11.71.G05.1.454.CMB.2.raw
  modified_base (316)..(316): a, c, t, g, unknown or other
  modified_base (355)..(355): a, c, t, g, unknown or other
  modified_base (358)..(358): a, c, t, g, unknown or other
  modified_base (380)..(380): a, c, t, g, unknown or other
  modified_base (526)..(526): a, c, t, g, unknown or other
tcagcgagagataccacgaccggtgctcgatttagtgtcgtcgcaagagagaggggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggaggcgtggtccaggccgtgggacgtccctgagactctcctgacagcctctggctcaccttcattacctagtcggcatcgccacgtcggtccncagactccgaggcgagggggctggagtggtgctagtttnttnatatgaatagaatgtgtacttntatcagacctcgtagacggctatccacgtactcagacgaactactccaggtccacgtacgcgttagtactcgtagacctaaagtacgaaacgacgtccgtaggaagtaacgtacgttagggaacgggttacgtaaacccggggttnttacggggttactttaacggtttaaccgttaggttaaccggaacgggttaaaagtttagtttaacgttaaaggttaaggggg

SEQ ID NO: 409868 - DNA, 612 bp, Homo sapiens
  misc_feature: GZ8MTXP01DZFKJ.11.71.G05.1.454.CMB.2.raw
  modified_base (248)..(248): a, c, t, g, unknown or other
  modified_base (295)..(295): a, c, t, g, unknown or other
  modified_base (344)..(344): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagcctgggaggtccctgagactctcctgtacngcctctggcttcaccttcattacctatggcatgcacgtcgggtcccncagacctccgaggcgagggggctgggaggtgggtgctagtttattcatntgtataggtaaatgtgtacttctaattcagtacctccggtagaacgggcctattccgaccgtctaccagacgactatccgaggcacacgtctagtactcgtaggaactaaagtacgaaacgcgcccgtaggaagacggtcgtagggaacggaccgtacgggtcttagggttacgtttaacgttaacgtggtaacgttaacgttaaagttactttaagtaagtaagggtacgggtcggttaccgggttaacgggggttcgtttaacggg

SEQ ID NO: 409869 - DNA, 609 bp, Homo sapiens
  misc_feature: GZ8MTXP01AJKML.11.71.G05.1.454.CMB.2.raw
  modified_base (165)..(165): a, c, t, g, unknown or other
  modified_base (252)..(252): a, c, t, g, unknown or other
  modified_base (297)..(297): a, c, t, g, unknown or other
  modified_base (559)..(559): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagnggtgtccagtgtcaggtgcaacgtggaggagtcgtgggggagcgtggtccagccgtgggagtccctgagactctcctgtacagcctntggcttcaccttcattaccctatggcatcgccacgtcgggtcccncagacctcccgagggcggagggggctaggggaggtgggggtgactaggttttatttcaattagtgtaagtacgggaaattgtacgtactttactattccgagtaccctcgggtaggaacggtccgtattcccaccgtctccagacgactatccgagccacgacgtctgtactcgtacggacaaagtcgaaacgacgccctaggagacgtcgtaggacggacgacggtcgtgttgttaacttcgtagtaggacgttaaagttntttaacgagtaagggtaggtcggttacggtaacgggggttcgtttaacgg

SEQ ID NO: 409870 - DNA, 647 bp, Homo sapiens
  misc_feature: GZ8MTXP01B07O9.11.71.G05.1.454.CMB.2.raw
  modified_base (353)..(353): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggagtccctgagactctcctgtacagcctctggcttcaccttcacttacctatggcatgcacgtcggtccgccagacctccgaggcgagggggctgggagtgggtgctagtttatcatatgatggaaatgtnacttctatcagactccgaggaacgggccattccaccgtctaccagacgaactaacttccaggtaccacgacgaccttgtactcgtacggaacctaaagtacgaaaccgagacccgttaggaacggtaggccgtaggggaaacggtaccgaccgggtctttacgggttaggtttaaacctttacggtaggttaacggttaaccggttaaaagtttaccgttttaagaaacggttaacggggttaggggtacggttaaccgggggttaaccggggggttccggtttttaacccggg

SEQ ID NO: 409871 - DNA, 635 bp, Homo sapiens
  misc_feature: GZ8MTXP01EDQ1Q.11.71.G05.1.454.CMB.2.raw
  modified_base (245)..(245): a, c, t, g, unknown or other
  modified_base (249)..(249): a, c, t, g, unknown or other
  modified_base (258)..(258): a, c, t, g, unknown or other
  modified_base (263)..(264): a, c, t, g, unknown or other
  modified_base (269)..(269): a, c, t, g, unknown or other
  modified_base (359)..(359): a, c, t, g, unknown or other
  modified_base (593)..(593): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttggctgagctgggttttcctcgttgcttcttttaagaggtgtccagtgtcaggtgcaactggaggagtcgtgggggagcgtggtccagccgtgggacgtccctgagactctctgtacngctntgctcactnatacnngcatncacgtggtcccagctccgaggcgagggggctgggaggtggggtcggctaggttttaatttcagttagtggtaatacggggtaaaatggtntaacttttctaatttcgagtaccttacccgggtaggtaaaccggggtccgtaaacttttcccgaacccgttctacccgaaggaacgtaaccgtaactttacccgacgggaccaccgaacgtcttagttaactcgttacgggaacttaaaagttacgaaactaacggccgtaggagaagcgtaggacggacgacggcttggttagttattacgtagttagagttaagttactttntaagtgggtaggtacggttacggttaacgggggttctttcgg

SEQ ID NO: 409872 - DNA, 589 bp, Homo sapiens
  misc_feature: GZ8MTXP01BU2O1.11.71.G05.1.454.CMB.2.raw
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtgggttttcctcgttgctctttaagaggtgtccagtgtcaggtgcaactggaggagtcgtgggggagcgtggtccaggcctgggagtccctgagactctcctgtacagcctctggcttcaccttcattacctatggcatgcacgtgggtcccncagactccgaggcagggggctgggaggtggggtggctaggtttatttcagtatgatagggaaattggtgtactttactattcgaagtacctccggtaggaacggggtccattccacccgtctaccgagacgactaattacccgaggcacacgctgtactcgtaggacaaagtcgaactagcctaggagtaacgcgtaggacggacgacgggtctggttagtacgttagtgtacgaacgttaagttatttaactagtaaggtagggtacggttacggttaacgggggttcgtttaacgg

SEQ ID NO: 409873 - DNA, 613 bp, Homo sapiens
  misc_feature: GZ8MTXP01BQLE8.11.71.G05.1.454.CMB.2.raw
  modified_base (176)..(176): a, c, t, g, unknown or other
  modified_base (261)..(261): a, c, t, g, unknown or other
  modified_base (273)..(273): a, c, t, g, unknown or other
  modified_base (300)..(300): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgctcttttaagnggtgtccagtgtcaggtgcaactggaggagtcgtgggggagcgtggtccagccgtgggagtccctgagctctcctgtacagcctnggcttcaccttnatacctatggcatgcacgtcggtcccnccagacctccgaggcgagggggctggagtgggtgctagtttattcatatgatgaaatagtgtactttcattcagtacgtccggtaggaaacgggccctattcccgaaccgttcctaccgaagacgaacctaacttccgaaggccaaccgacgtactgtactacctaggaaccaaacgtgaaaccacgtacctaggagtacgccgtaggaacggaacgtaccggttgttagttacgttaacgtttacgttggttcgaacgttaaaagtactttaagtagtaacgttaggggtaacgttaaccgggtaacggggg

SEQ ID NO: 409874 - DNA, 590 bp, Homo sapiens
  misc_feature: GZ8MTXP01E1AGS.11.71.G05.1.454.CMB.2.raw
  modified_base (186)..(186): a, c, t, g, unknown or other
  modified_base (204)..(204): a, c, t, g, unknown or other
  modified_base (342)..(342): a, c, t, g, unknown or other
  modified_base (392)..(392): a, c, t, g, unknown or other
  modified_base (395)..(395): a, c, t, g, unknown or other
  modified_base (398)..(398): a, c, t, g, unknown or other
  modified_base (413)..(413): a, c, t, g, unknown or other
  modified_base (419)..(419): a, c, t, g, unknown or other
  modified_base (463)..(463): a, c, t, g, unknown or other
  modified_base (495)..(495): a, c, t, g, unknown or other
  modified_base (558)..(558): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggtttttcctcgttgcttctttttaaagnggtgtccagtgtcaggtncaaactgggaggagtcgtggggggagcggttggtcccaggcccgttggggacggtccctgacgtaccttctcctgtacaggccctcgtggtctccacctttcaacttaccctatggcattggcaccgtcgggtccccnccagacctccgagggccaggggggctgggggagtgggggtgctaggtttnttnatngaattgggaaatgtntacttnattcagacctccgtagaaggccgtattccgaccgttcaccgaanacgacaacttccgagcacgacgctagtatcgngacaaagtcgaacacgtccagcggaagcttggacggacgacgggtacttgttgttactttcgngttaagacgtaaagttcttaacgaagtaaggg

SEQ ID NO: 409875 - DNA, 600 bp, Homo sapiens
  misc_feature: GZ8MTXP01D65I0.11.71.G05.1.454.CMB.2.raw
  modified_base (246)..(246): a, c, t, g, unknown or other
  modified_base (251)..(251): a, c, t, g, unknown or other
  modified_base (292)..(292): a, c, t, g, unknown or other
  modified_base (354)..(354): a, c, t, g, unknown or other
  modified_base (394)..(394): a, c, t, g, unknown or other
  modified_base (399)..(399): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagcctgggaggtccctgagactctcctgtacngcctntggcttcaccttcattacctatggcatgcacgtgggtcccncagacctccgaggcgagggggctgggagtgggtggctagtttattcatatgatggaaatgtntacttctattcagtactccggtagacgggcattcacgtcncaganacaattccagacacacgctgtatctaggactaaagtcgaaacgacgtccgtaggaacgacgtaccgtaggacggtaccgacgggtaacctggttaggttactttaaccgtaggttacggttaaaccggttaaaacgttagttttaacgtaaagtaagggtaagggtcggttaaaccggttcgggggttccgttttaaccgg

SEQ ID NO: 409876 - DNA, 692 bp, Homo sapiens
  misc_feature: GZ8MTXP01B83QV.11.71.G05.1.454.CMB.2.raw
  modified_base (247)..(247): a, c, t, g, unknown or other
  modified_base (253)..(253): a, c, t, g, unknown or other
  modified_base (295)..(295): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggagtccctgagctctcctgtacngtcctntggtcttcacccttcattacccatggcatgcacgtggtcccnccagacctccgaggcgagggggctgggaggtgggtgctagtttattcatatgtaataggaaattgtactacttatacttcgacgtaccgtccgggtaggaacgggtccctattcccgtacccgtactaccgaagtaacgaactaacgttaccgacggtacctaacgaccgcttacgtaacttaccgttaacgggaactaaaacgttacgaaaccgacgtaacccgttagggaacgtacggtacgtaacggggaacggaccggtaccgggtaacggttagttacggtttacgttacggttaggtaacggttaaacgttaaaggttacgttttaacgtaaggttaacgggtaacgggttacgggttaccggggttaaccgggggttcgttttaaccggg

SEQ ID NO: 409877 - DNA, 682 bp, Homo sapiens
  misc_feature: GZ8MTXP01EHUM8.11.71.G05.1.454.CMB.2.raw
  modified_base (267)..(267): a, c, t, g, unknown or other
  modified_base (298)..(298): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtggggggagcgtggtccagccgtgggagtccctgagactctcctgtacagcctctggcttcaccttnattacctagtggcatcgcacgtcgggtcccncagacctccgaggcgagggggctggggaggttgggggtgctagtttattcattagtgataggaaatgtgtactttctattcgaagtcttcccgggtagaacggggtccctaagtttcccgtacccgttctaccgaacgacgaacctaagtttacccgaggtaccaactacggtacctaggtaacgttcctaggggaacctaaaagttaccgaaacccgtaaggacccttagggaaagtaaccgggtacgtaacgggaacggtaccgtaacggtaacgttaggttacggttaacgtttacgtaggtaacgttaacggttaaagttacgtttaagtaagttaagggtacgggtacggttaccggggttaacggggttccgtttcgg

SEQ ID NO: 409878 - DNA, 664 bp, Homo sapiens
  misc_feature: GZ8MTXP01BSVI8.11.71.G05.1.454.CMB.2.raw
  modified_base (267)..(267): a, c, t, g, unknown or other
  modified_base (273)..(273): a, c, t, g, unknown or other
  modified_base (317)..(317): a, c, t, g, unknown or other
  modified_base (352)..(352): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttggggttttcctcgttgcttcttttaagaggtgtccagtgtcaggtgcaacgtggaggagtcgtgggggagcgtggtccagccgtggggacgtccctgagctctcctgtacncgcctntcggtctcaccttcacttacctagtggcatgcacgtcgggtccnccagactccgaggcgagggggtcaggacggtgggnggctaggtttattgatatgtaaataggaatgtcgtacttctattcgagtcgtccggtaggaacgggtccgacttcccgaccgtacctacccgaaggtaacgtaacctaacgttacccgaacgggcccaactaccggtcttacggtactacgtacgacctaaagtaccgtaaactacgtaccgtagaggtaacggtcgttacgggaacggaccgtaaccgggtcgtttacggggttattaacccggtttaacgttgggtaacccggtaaacggtaaaggtttaccgttttaaacggttaacgtttaaaggggg

SEQ ID NO: 409879 - DNA, 703 bp, Homo sapiens
  misc_feature: GZ8MTXP01DSP8W.11.71.G05.1.454.CMB.2.raw
  modified_base (249)..(249): a, c, t, g, unknown or other
  modified_base (254)..(254): a, c, t, g, unknown or other
  modified_base (272)..(272): a, c, t, g, unknown or other
  modified_base (274)..(274): a, c, t, g, unknown or other
  modified_base (277)..(277): a, c, t, g, unknown or other
  modified_base (289)..(289): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtggggggagcgtggtccagccgtgggacgtccctgagactctctgtacngcctntgctcacttcatacctangnatncacgtggtcccncagacctccgaggcgagggggtctgggaggtgggtgactaggtttattcaagtagtagaagtaggtaaaattggtacgtactttaacttaattcgaaacgtacccgttaccggtagggaaaccgggggtcccttaacttcccgtacccgttctaccccgaaaggaaccgtaaacctaaacgttaccccgaaggacccaaaccgaccggtaccttaggttaactacccgttaaggggaacctaaaagtacgaaaaccgtacggtacccgtaggaaggaacggcgtacgggaacggtaaccgcggggtaacttgggttagttaacttgtaggtacgaaacgttaaaagttctttaacgtaaggttaacgggtaagggtacggttaccggggttaaccgggggttcgtttaaccggg

SEQ ID NO: 409880 - DNA, 771 bp, Homo sapiens
  misc_feature: GZ8MTXP01DY9O7.11.71.G05.1.454.CMB.2.raw
  modified_base (309)..(309): a, c, t, g, unknown or other
  modified_base (338)..(338): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggagtccctgacgactctcctgtacagcctctggctcaccttcattacctatggcatgcactgggtccncgacgactccgtaggcggagggggacggnggtaggtggggtggcgtagttatttctagtatgtaagtaggtaagtaagttggtactttacttacgttactacgaaccgtaccggtacggtaacggggtaccggtacgttaccgttaacccgttaccgtaccccgtaacgtaacgggaaaccgtaaacctttaacccgtaacgggtacccggaaaccaaacccggtaccgttaacggtttaacttaccgttacgaacccgttaaaagtaaaacggttaacccgaaacgggtaccccgttaacgggtaacgggtaaagaacccggttggggtaaacggggttaaacccggaaaccccggggtgtttaaccggttcgggtttaaagtttaacccgggttacgggtttaaggtaaacccgggtaaaacggttaacgttttttaacggttaacgttttaaaaggggg

SEQ ID NO: 409881 - DNA, 586 bp, Homo sapiens
  misc_feature: GZ8MTXP01CUVOQ.11.71.G05.1.454.CMB.2.raw
  modified_base (274)..(274): a, c, t, g, unknown or other
  modified_base (292)..(292): a, c, t, g, unknown or other
  modified_base (472)..(472): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagccgtgggagtccctgagactctcctgtacagcctctggcttcacctttcattacctanggcatgcacgtggtcccncagacctcgaggcgagggggctgggaggtgggtgctaggtttattcaatatcgaagtaggaaaatgtagtaccttatattcagtaccgtcgtaggacgggcctatcccaccgtctaccgagacgaactaacgttaccgaggaccacgaacgtctagtatccgagaactaaagtcgaaacncgcctagagacgtcgtaggaaggacctaggctgttgttaattcgtagtcgaagttaagttacttttaagaagttaaggaggtacggaccggttaacgggggttccgttttaagg

SEQ ID NO: 409882 - DNA, 584 bp, Homo sapiens
  misc_feature: GZ8MTXP01C832X.11.71.G05.1.454.CMB.2.raw
  modified_base (477)..(477): a, c, t, g, unknown or other
tcagcgagagataccacgaccggtgctcgatttagtgtcgtcgcaagagagaggagccccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtggggggaggcgtggtccagccgtgggagtccctgagactctcctgtacagcctctggcttcaccttcattaccctatggcatgcacgtgggtcccgcagacctccgaggcgaggggggctgggagtggggtggcagtttattcatatgataggaaatgtgactttactattcagtacctccgtaggaacggggccattccacccgtctaccagagactaattccaggcacacgctgtatcctaggactaaatgaacagcctgacgagctggacggacncggtctgttgttaacttacgttaggtggttaaacgttaaaggttactttaagtaagtaagggtaagggttcgggttaaccgggttaacggggggcgttttaaccggg

SEQ ID NO: 409883 - DNA, 660 bp, Homo sapiens
  misc_feature: GZ8MTXP01CVGX5.11.71.G05.1.454.CMB.2.raw
  modified_base (256)..(256): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggtttttcctcgttgcttcttttaagaggtgtccagtgtcaggtgcaacgtggaggaggtcgtggggggaggcgtggtccaggccgtggggacgtccctgacgactctcctgtacngcctctggcttcaccttcacttacctatggctatcgctacgtcgggtcccgacagacctccgaggcggaggggggtctgggacggtggggtaggtctaggtttattcgaatgtagacgttaggaaatgtgtactttactattcgaagtaccgttccgggtaggaacgggtcctacttacccgacccgttcaccgaagagtaacctaacgttacccgaaggaccaacgtacgtcttgtaactacgacgtaaacaaagttacgaacgacgtccgaggacgtacgaccgttagggaaccggacgtacggggtcttgggttacttacgttcgtaggtacgaaacgggttaattactttaacgaagtaacggtaggtcgttaaccgggttaacgggggttctttaacgg

SEQ ID NO: 409884 - DNA, 584 bp, Homo sapiens
  misc_feature: GZ8MTXP01APJDS.11.71.G05.1.454.CMB.2.raw
  modified_base (247)..(247): a, c, t, g, unknown or other
  modified_base (294)..(294): a, c, t, g, unknown or other
  modified_base (407)..(407): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggaggagtcgtgggggaggcgtggtccagccgtgggagtccctgagactctcctgtacngcctctggccttcaccttcattacctatggcatgcacgtgggtcccnccagacctccgaggcgagggggctgggaggtggggtgctagtttatttcattatgaatagggaaatgtgacttactattcagacctcgtagaacgggtccgattccaccgtcnccagacgacacttccaggcacacgctagtactcgtaggacaaatgaacacgcctaggacgaaggctaggaacggaccgacgggtcttgttgttaattaccgtggtagttaccggttaaagttatttaacgtaagtaaggtagggtacggacgggttaacgggggttcgtttaaccgg

SEQ ID NO: 409885 - DNA, 652 bp, Homo sapiens
  misc_feature: GZ8MTXP01BF7WU.11.71.G05.1.454.CMB.2.raw
  modified_base (275)..(275): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggaggtccctgagactctctgtacagcctctggcttcaccttcattacctanggcatgcacgtgggtcccgccagacctccgaggcgagggggctgggagtgggtggctaggttatttcgatagtgagtaggaaaatgtgtacttctattcagtacctcgtagaaggccgtattccacccgtctaccagacgactaacttccgacggtcaaccgacgcttgtaactcgtaggactaaaacgtacgaaacgacgacccgtagaacgaacggtccgtagggaaaccggaccgacggggtaaccttgggttaagttaacgttttaccgtaggttaacggttaaccggttaaaagttaccgttttaagtaaaggttaacgggtaagggttcgggttaaaccggggttaaccggggggttccgttttaaccggg

SEQ ID NO: 409886 - DNA, 615 bp, Homo sapiens
  misc_feature: GZ8MTXP01BWYW7.11.71.G05.1.454.CMB.2.raw
  modified_base (249)..(249): a, c, t, g, unknown or other
  modified_base (277)..(277): a, c, t, g, unknown or other
  modified_base (294)..(294): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgacaacgtggaggagtcgtgggggagcgtggtccagccgtgggagtccctgagactctcctgtacngcctctgtccttcaccttcattacctanggcatgcacgtcggccncagacctcgaggcgagggggctgggagtgggtgctagtttattcatagtgtataggtaaatgtgtactttaactattcagtaccgttccggtaggaaccggggtccaatttcccgacccgtctaccgaagtacgaactaacgttcccgaggaccaccacggcttaggtacttaccgtagggaaaccaaagtacggaactacgcctaggaacgagccgtaggacggaccagggtctgttagttacgttagtagtcgttaacgttaaagttactttaagtaagtcggaaggtacggttaccggtaacgggggttctttaacgg

SEQ ID NO: 409887 - DNA, 670 bp, Homo sapiens
  misc_feature: GZ8MTXP01AU2E0.11.71.G05.1.454.CMB.2.raw
  modified_base (272)..(272): a, c, t, g, unknown or other
  modified_base (290)..(290): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacagcctctggccttcaccttcattacctanggcatgcacgtgggtccncagactccgaggcgagggggctgggagtgggggtcgctagttatttacgatagtgataggaaaattgtagtactttacattccgaagtactcccgggtagaaacggggtccctatttccgacccgttctaccgaaggaacgtaactaacgttacccgaagggtacccaacgaaccgtcttaggtaacttcgttacgggaaccaaaagttcgaaaccacgacccgttaggacgaacggctacgggacggaaccgtaacccgggtcgttaggttacgttaaacgtttaccgtagggtacggttaaacggttaaaagttacgttttaacgtaagttaacgggtagggtacggttacccgggttaacgggggccttttaacggg

SEQ ID NO: 409888 - DNA, 639 bp, Homo sapiens
  misc_feature: GZ8MTXP01CYQ8G.11.71.G05.1.454.CMB.2.raw
  modified_base (249)..(249): a, c, t, g, unknown or other
  modified_base (297)..(297): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtggggagtccctgacgactctcctgtacngcctctgtcttcaccttcattacctatggcatcgcacgtcgggtcccncagcctcgaggcgagggggctgggaggtgggtgctagtttattcattgtgataggaaatgtgtacttctattcgagtacctccggtagaacgggccgtattcccaccgtctaccgaagacgaactaacttaccgaacggtcaaccgaccgtcttaggttactaccgtacggtaaacctaaagttaccgaaaccgacgtaccccgtaggaacggtaacggccgttaagggaaccggaaccgaacgggtcttaggttacgttattacgtggtacgttaacggttaaattacttaagtaagtaaggtacgggtacggttacggttaacgggggttcgtttaacgg

SEQ ID NO: 409889 - DNA, 648 bp, Homo sapiens
  misc_feature: GZ8MTXP01E2AL6.11.71.G05.1.454.CMB.2.raw
  modified_base (299)..(299): a, c, t, g, unknown or other
  modified_base (605)..(605): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtggggaggtccctgagactctcctgtacacgcctctggtccttcaccttcattacctatcggcatgcacgtcgggtcccnccagacctccgaggcggagggggctgggaggtgggtggtctagtttatttcagttatcgtaataggaaaattgtgtacttactatcagtaccgtccgtaggaacgggtccgtattacccgacccgttacctacccgaagtaacgaacctaacgttcccgaacgggacctaaccgaccgccttaggtaactccgttaggggaactaaatacggaaactcgacccgtagaggaccgcgtaggaacggtacaacgggtcgttagttagtaagtttacgtagtacggttaacgttaaaggttactttaanagtaaggagggtacgttacgggtaacgggggttcgtttaacgg

SEQ ID NO: 409890 - DNA, 626 bp, Homo sapiens
  misc_feature: GZ8MTXP01DJJ39.11.71.G05.1.454.CMB.2.raw
  modified_base (291)..(291): a, c, t, g, unknown or other
tcagcgagagataccacgaccggtgctcgatttagtgtcgtcgcaagagagaggagccccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccagcctgggagtccctgacgactctcctgtacagcctctggcttcaccttcattaccatggcatgcacgtggtccncagacctcgaggcgagggggctggagtgggtgctagttatttcgatatgataggaaatgtcgtacttactatttcgaagtaccgtccggtagaaacgggtccgtaattccgaacccgttctccgaagacgaacaaacgttccgaggcacgaccgctagtaactcgtaggaactaaagtacgaacacgtcccgtagagaacgtctaggacggaaccgtccgggcttggttaggttaattacggttcgtaggttaacggttaaaagttagttttaaccgtaagttaacggtaaggggttacggttaaccgggttaaccgggggttcgttttaaccgg

SEQ ID NO: 409891 - DNA, 600 bp, Homo sapiens
  misc_feature: GZ8MTXP01AIKDO.11.71.G05.1.454.CMB.2.raw
  modified_base (247)..(247): a, c, t, g, unknown or other
  modified_base (252)..(252): a, c, t, g, unknown or other
  modified_base (273)..(273): a, c, t, g, unknown or other
  modified_base (289)..(289): a, c, t, g, unknown or other
  modified_base (333)..(333): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagcctgggagtccctgagactctcctgtacngcctntgcttcaccttcattacctangcatgcacgtggtccncagacctccgaggcgagggggctgggagtgggtgctagttattnatatgatggaaatgtcgtacttctattcgagtaccgtcggtaggaacgggctattcccaccgtctaccgagacgaactacttaccgagtccacgacgctagtactaccgtaggactaaagtacgaaacgcgacccgtagaacgacggccgtagggaaccggaccgacgggtaagttggttacgttagttacgtggtagttaacgttaaagttctttaagtaagtaaggtagggtacggttacgggttaacgggggttcgtttaacgg

SEQ ID NO: 409892 - DNA, 536 bp, Homo sapiens
  misc_feature: GZ8MTXP01B9OFT.11.71.G05.1.454.CMB.2.raw
  modified_base (305)..(305): a, c, t, g, unknown or other
  modified_base (490)..(490): a, c, t, g, unknown or other
  modified_base (518)..(518): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggagtccctgagactctcctgtacagcctctggctcacttcattacctatgcatgcactggtccncagactccaggcgagggggctggagtgggtgctacgttattcgatatgaattaggaatgtgtacttctattcagactccgtgaaggccgattcaccgtctaccgagacgacaactccagccaacgacgtctgtactcagtacaaatcgaaactagcctagagaacgcttggacgacgaaccggtngttggttaattctagtgacgtaaagttntttaacgttaagtaaggg

SEQ ID NO: 409893 - DNA, 593 bp, Homo sapiens
  misc_feature: GZ8MTXP01EWLIO.11.71.G05.1.454.CMB.2.raw
  modified_base (251)..(251): a, c, t, g, unknown or other
  modified_base (256)..(256): a, c, t, g, unknown or other
  modified_base (295)..(295): a, c, t, g, unknown or other
  modified_base (327)..(327): a, c, t, g, unknown or other
  modified_base (358)..(358): a, c, t, g, unknown or other
  modified_base (365)..(365): a, c, t, g, unknown or other
  modified_base (496)..(496): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtggggggagcgtggtccaggccgtgggacgtccctgagactctcctgtacngcctntgtcttcaccttcattaccatggcatgcacgtcggtccncagcctccgaggcgagggggctgggagtgggngctagttattcatatggtaataggaaatgtntactttntattcgagtacctcgagaacgggtctattcccgacgtcacagacgactaactcgagtacacgactctagtatctagaactaaatacgaacgacgccgtagaggaacgtcgtagggaacgtaccgacgggtnttagttacggtaactttacgtagtacggaaacgttaagttacgtttaagtagttaagggtagggtacggttaccgggttcgggggttctttaaccgg

SEQ ID NO: 409894 - DNA, 582 bp, Homo sapiens
  misc_feature: GZ8MTXP01BWYZV.11.71.G05.1.454.CMB.2.raw
  modified_base (243)..(243): a, c, t, g, unknown or other
  modified_base (292)..(292): a, c, t, g, unknown or other
  modified_base (336)..(336): a, c, t, g, unknown or other
  modified_base (370)..(370): a, c, t, g, unknown or other
  modified_base (538)..(538): a, c, t, g, unknown or other
  modified_base (544)..(544): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctctgtacngcctctggccttcaccttcattacctatggcatcgctacgtcgggtccncagacctccgaggcgagggggctgggagtgggtggctaggtttntttcgatagtgaagtggaaaattgtgtactttanattcaggtactccggtaggaacggggtccctatttacccgacccgtctaccgagtacgactaacgttccgagacacgacgctagtatctgactaaagtcgaaacagccgtgacgaagctagggacggaccgacggtctgttcgtattacgtgtacgaagttaaagttntttaanagtaaggagggtggttacggtaacgggggttcgtttcg

SEQ ID NO: 409895 - DNA, 588 bp, Homo sapiens
  misc_feature: GZ8MTXP01DP8CO.11.71.G05.1.454.CMB.2.raw
  modified_base (253)..(253): a, c, t, g, unknown or other
  modified_base (258)..(258): a, c, t, g, unknown or other
  modified_base (305)..(305): a, c, t, g, unknown or other
  modified_base (308)..(308): a, c, t, g, unknown or other
  modified_base (448)..(448): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttggggttttcctcgttgcttcttttaagaggtgtccagtgtcaggtgcaactggaggagtcgtggggggaggcgtggtccaggccgtgggaggtccctgacgactctcctgtacngcctntcgcttcaccttcattaccatggcatcgcacggtcgccacacgtccncgngacggggcgggtgagggtgggtgggtcgacgttagtttactactatagtagtaagtagtaaagtgtatacttaatatgactcgtacgtaggacgcttactccgtacctctacgagactactactcgacgcacgcgtcgtntactacagaaactaagtacacgacgtcgtaggagtacgtgtacggacggaccgtacgtgtagttacgttacgttagtaggtcttaaagttctttaataagtaagtaaggtagggtcgacggggttcggttgtttaaccgg

SEQ ID NO: 409896 - DNA, 578 bp, Homo sapiens
  misc_feature: GZ8MTXP01CR1R7.11.71.G05.1.454.CMB.2.raw
  modified_base (231)..(231): a, c, t, g, unknown or other
  modified_base (244)..(244): a, c, t, g, unknown or other
  modified_base (257)..(257): a, c, t, g, unknown or other
  modified_base (271)..(271): a, c, t, g, unknown or other
  modified_base (363)..(363): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctganactctcctgtacngcctctggcttcnccttcattacctanggcatgcacgtgggtcccgccagacctccgaggcgagggggctgggaggtggggtggctagtttatttcgatatgaattagggaaaattgtntactttactatttcagtaccgtcccggtaggaacgggccctaattcccaccgtctaccagacgacaaacttccaggcacacgctagtatcctggacaaatgaacagcctgagagctaggacggtacgacggctggttagttacttacgtggtgaacgttaaagttacttttgaagtaaggtagggtcggttacggtaacgggggttcgtttaacg

SEQ ID NO: 409897 - DNA, 613 bp, Homo sapiens
  misc_feature: GZ8MTXP01CA64G.11.71.G05.1.454.CMB.2.raw
  modified_base (305)..(305): a, c, t, g, unknown or other
  modified_base (356)..(356): a, c, t, g, unknown or other
  modified_base (371)..(371): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtggggggaggcgtggtccagccgtgggagtccctgagactctcctgtacagtcctctggtccttcacccttcattaccctagtggcatcgccacgtcgggtcccnccagacctccgaggcgagggggctggggagtggggtgctagttatttcatntgactaggaaatgtntacttctattcagtaccgtccggtagaacgggcctattccgaccgtctaccgagacgactaacgttccaggaccacgacgtctagtactctaggaactaaatcgaaacagtcctaggacgtacgcgtagggaacggacgacgggtcgttggttagttattacgtaggtacgttaacggttaagttactttaagtaaggtaacggtagggtacggttacgggttccgggggttcgtttaacgg

SEQ ID NO: 409898 - DNA, 545 bp, Homo sapiens
  misc_feature: GZ8MTXP01CBXUR.11.71.G05.1.454.CMB.2.raw
  modified_base (307)..(307): a, c, t, g, unknown or other
  modified_base (333)..(333): a, c, t, g, unknown or other
  modified_base (350)..(350): a, c, t, g, unknown or other
  modified_base (526)..(526): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggaggagtcgtgggggagcgtggtccagccgtgggacgtccctgacgctctcctgtacagcctctggctcaccttcattacctatggcatgcacgtggtccnccagactccgaggcgagggggctggngtggggtgctagttatnatatgaataggaatgtgtacttctattcagtctcgtgaacggcatcgacgtctcagacgacacttcaggccacgacgtctagtactctagaccaaatacgaactagcctaggagaagcgttaggacggacgacggtcgttcgttgttacgttaacgtggtaacgacggtaaagttntttcgttaaggttaacggg

SEQ ID NO: 409899 - DNA, 681 bp, Homo sapiens
  misc_feature: GZ8MTXP01BSCJE.11.71.G05.1.454.CMB.2.raw
  modified_base (241)..(241): a, c, t, g, unknown or other
  modified_base (261)..(261): a, c, t, g, unknown or other
  modified_base (271)..(271): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggtttcgcgttaggctctttaagaggtgtccagtgtcaggtgcaatggaggagtcgtgggggagcgtggtccagcctgggagtccctgagactctctgtacngtcctcgtcgtctcaccttnacttactagngcagtcgactacggtcggtccacgagaccgtcggacgggcggtacgggggcgtagggtagggttcggggtacgtacgttagttttacttacaagttagtaggtaagttaaggtaattacgttacgttacctttaacttacgttaacgaacggtacccgtacgggtacgggtaaccgggtctacttacccgaccgttactacgaaagtacgtaacttaacgtacccgagacctaacgtacgtacgtacgttacgtacgtacggtaacgtaaacgtaacgaacgtacgtacgtacgagtacgacgtacggacggtacgtcggtcgttagttagttacgttacgtagtacgttaacgttaacgttacgttaagtagtaaggtaggtacggttacgggtaacgggttcggttcg

SEQ ID NO: 409900 - DNA, 554 bp, Homo sapiens
  misc_feature: GZ8MTXP01A24XK.11.71.G05.1.454.CMB.2.raw
  modified_base (286)..(286): a, c, t, g, unknown or other
  modified_base (356)..(356): a, c, t, g, unknown or other
  modified_base (358)..(358): a, c, t, g, unknown or other
  modified_base (451)..(451): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggtgaggcgtggtccagcctgggagtccctgagactctcctgtacagcctctgcttcaccttcattaccatggcatgcactgggtccncagacctccgaggcgagggggctgggaggtgggtggctagttattcatatgataggaaatagtgaacttntnttcagtactccgtagaacgggctattcaccgtctccagagactaattccaggcacacgctgtactcgtagacaaatacgaacacgcctgaagngtacgtggacggacaacggtacgttggtacgttagttaacgtgttacgcgttaaagttaactttagtaagtaggagggttacggtaacggttcgggggtaacg

SEQ ID NO: 409901 - DNA, 701 bp, Homo sapiens
  misc_feature: GZ8MTXP01BKZGP.11.71.G05.1.454.CMB.2.raw
  modified_base (298)..(298): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgctcttttaagaggtgtccagtgtcaggtgcaacgtggaggagtcgtgggggagcgtggtccaggccgtgggacggtccctgagactctcctgtacagcctctggccttcacccttcattacctatggcatgcacgtgggtcccnccagacctccgaggtcgaggggggctgggagtggggtagctagttattcatatgataggaaatgtgtaccttatattcaagtacctcggtacgaaggggccctattcccacccgttctacccgaagacgaacctaagttaccccgaagggtccaacgaccgtctacggttaactccgttacggggaactaaaagttcgaaaccgtacggtaccccgttaggaacggtaacggtccggttaagggaaccgggtaacccgaaccggggtaaccgtttacgggttaggtttaaacgtttaaccggttgggttaacgttaccggttaaaagttacgttttaaccgtaagttaaggggtacgggttacgggttaaccgggttaacggggggttccgttttaacccggg

SEQ ID NO: 409902 - DNA, 659 bp, Homo sapiens
  misc_feature: GZ8MTXP01B9MEN.11.71.G05.1.454.CMB.2.raw
  modified_base (309)..(309): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggaggtcgtggggggagcggtggtccagccgtgggacgtccctgacgactctctgtacagtcctctggtccttctacccttctaattaccctagtggcatgctacgtcgggtccccncagacctccgaggcgagggggctgggaggtgggtgctaggtttattacgattagtagtagtacggaaagttgtagtactttactaattccgaacgtaccgtccggaggaaccgggtccgtaactcccgtaccgttaccgtaccgaagacgaactaacttaccgaacggaccaccgacgtccgttagtacgttccgtagggaacctaaaagtacgaaaccgcgtacccgtaggaacgtaaggtccgtagggaacgtaccgcgggtaactggttagttattacgtagtacgttaacgttaagttagttaagtacgtaaggtagtcggttacggtaacgggttcgtttaacgg

SEQ ID NO: 409903 - DNA, 725 bp, Homo sapiens
  misc_feature: GZ8MTXP01EB1WX.11.71.G05.1.454.CMB.2.raw
  modified_base (266)..(266): a, c, t, g, unknown or other
  modified_base (315)..(315): a, c, t, g, unknown or other
  modified_base (323)..(323): a, c, t, g, unknown or other
  modified_base (353)..(353): a, c, t, g, unknown or other
tcagcgagagataccacgaccggtgctcgatttagtgtcgtcgcaagagagaggggggagctctgggagaggagcccagcactagaagtcggcggtgtttccattcggtgatcagcactgaacacagaggactcaccatggagtttgggctgagcgttgggttttcctcgttgcttcttttaagaggtgtccagtgtcaggtgcaacgtggaggagtcggtgggggagcgtggtccagccgtgggagtcctgagactctcctgacncgcctctcggctcaccttcattacctatcggctatgctacgtcggtccnccagaccnccgaggcgagggggctagggaggttggggngctagttatttcattagtagtaaagttagggtaattaggtacgtacctttactacgtttacgacgttacccgttacccggtagggtaaaccgggtccgtaacttacccgacccggttccttacccaagggtaaccgaaccgtaaacttcccggaaacgggacccaacgggtaccggtacttacggtttactacgttaacggaaaccttaaaagtaaccggaaacgttaccggaccgtacgggaaaggtaacggacggttacggggaaacggttaaaccgaccgggtactttaggttcgttaacgtttaaccggttagggtaaccgtaacgggttaaaagttaccgttttaacgttaaaggtttaaacggggg

SEQ ID NO: 409904 - DNA, 642 bp, Homo sapiens
  misc_feature: GZ8MTXP01ARFAL.11.71.G05.1.454.CMB.2.raw
  modified_base (249)..(249): a, c, t, g, unknown or other
  modified_base (277)..(277): a, c, t, g, unknown or other
  modified_base (299)..(299): a, c, t, g, unknown or other
  modified_base (352)..(352): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagtcttgggttttcctcgttgcttcttttaagaggtgtccagtgtcaggtgcaactggaggagtcgtgggggaggcgtggtccagccgtgggagtccctgagactctcctgtacngcctctggcttcaccttcacttacctancggcagtgcacgtcgggtcccnccagacctcgacggcggagggggctgggaggtgggtgctagtttattcatagngtactaggaaattgtactacttacgtattcgaacgtcttaccgggaggaacgggcctattccacccgtctaccaacgacgtaactaacttaccgaggaccacgaccgtctacgtactaccgtagggtaacctaaagtcgaaacgacgtacccgtagacgtagccgttagggaacggaccgtaacggtcgttaggttaggttaacttcgtaggtagttaacgttaaagttagtttaacgtaagtaacgggtaggtacgggttaccggttaacgggggttcccgtttaacgg

SEQ ID NO: 409905 - DNA, 676 bp, Homo sapiens
  misc_feature: GZ8MTXP01AGT0B.11.71.G05.1.454.CMB.2.raw
  modified_base (284)..(284): a, c, t, g, unknown or other
  modified_base (307)..(307): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgctcttttaagaggtgtccagtgtcaggtgcaacgtggaggagtcgtgggggaggcgtggtccaggccgtgggacggtccctgagacctctcctgtacacgtcctcgtggccttcaccttcaattacctanggctagtcgctacgtcgggtccnccagactccgaggcgagggggctagggacggtgggtggctaggtttatttacgattagtgaactagggaaatagtacgtacttacgttacttcgaagtaccgtcggtaggaacgggtcctacttccgacccgtctaccgaagacgtaactaactaccgaggtcaacgacgtcttagtactacgtacggaactaaagtcgaaacctcggtaccgtaggaacgaacggtaccgtaagggaacggaccgtaccgggtcttacgggttagtttaaacgttacggttacggtacggttaaccggttaaagttactttaagtacgtaaggggtagggttacgggttaccgggttaacgggggttccgtttaacgg

SEQ ID NO: 409906 - DNA, 550 bp, Homo sapiens
  misc_feature: GZ8MTXP01EKEPZ.11.71.G05.1.454.CMB.2.raw
  modified_base (292)..(292): a, c, t, g, unknown or other
  modified_base (325)..(325): a, c, t, g, unknown or other
  modified_base (353)..(353): a, c, t, g, unknown or other
  modified_base (389)..(389): a, c, t, g, unknown or other
  modified_base (450)..(450): a, c, t, g, unknown or other
  modified_base (471)..(471): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccaggcctgggagtccctgagactctcctgtacagcctctggcttcaccttcattacctatggcatgcacgtgggtccncagacctccgaggcgagggggctgggagtgggngctagttatttcatatgatggaaatgtntacttatattcagtacctccgagagggcgtacttcnccgtctccagacgaacaattacgacgacacacgctgtatctaggacaaatacgaacagtcngagagcgtaggacgacgcggngtgttgttacttagtggtagacgttaaagttatttaactaagtaaggtacgggtgacgggtaacggggttcgtttaacg

SEQ ID NO: 409907 - DNA, 660 bp, Homo sapiens
  misc_feature: GZ8MTXP01BRYXV.11.71.G05.1.454.CMB.2.raw
  modified_base (184)..(184): a, c, t, g, unknown or other
  modified_base (315)..(315): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagtcttgggttttcctcgttgcttcttttaagnggttgtccagtgtcaggtgcaacgtggaggagtcgtgggggagcgtggtccagccgtgggacgtccctgacgactctcctgtacagcctcgtggcctcaccttcacttaccatggcatgccacgtggtccnccagacctcgaggccgagggggctgggagtgggtggctaggtttattcgatagtgaaataggaattgtagtaccttctaagttccaaaggtaccttcccggtaggaacggggtacccgtacgttacccgtacccggttaccgttacccgaagtaacgtaacctaaacgtttcccgaacgggtacccaccggtaacccggtcttacggttactcgtacgtaactaaacgttacgaaacgtacggtacccgtaggaacggtaacgtacgttaggaacggacgtaacgggtcgttggttgttacttaacgtgtaacggtaacgtaagttactttcgttaagttaaggg

SEQ ID NO: 409908 - DNA, 657 bp, Homo sapiens
  misc_feature: GZ8MTXP01DO54G.11.71.G05.1.454.CMB.2.raw
  modified_base (254)..(254): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgacaacgtggaggaggtcgtggggggagcgtggtccaggccgtgggacgtccctgacgactctcctgtacngcctctcgtcttcaccttcattacctatggcatcgctacgtcgggtcccgcagacctccgaggcgagggggctagggaggtgggtgtctagtttattacatagtcgtaagtacggtaaaatgtagtactttactaattcgagtaccgtcggagaacggcctatccgaccgtcaccagacgactaacgtccgaggccacgacgtactgtaactccgtaggaacctaaagtacgaaacgacgtccgtaggaacggtaacgtccgtaagggaacggtaaccgtaccgggttcttaggttacgtttaaacgttagtacggttacgttaaaacgggttaatttacgtttaagtaaagggtaagggtacgggtacgggttaccggggttcggggttcgttttaaccggg

SEQ ID NO: 409909 - DNA, 650 bp, Homo sapiens
  misc_feature: GZ8MTXP01ALTBJ.11.71.G05.1.454.CMB.2.raw
  modified_base (183)..(183): a, c, t, g, unknown or other
  modified_base (201)..(201): a, c, t, g, unknown or other
  modified_base (267)..(267): a, c, t, g, unknown or other
  modified_base (272)..(272): a, c, t, g, unknown or other
  modified_base (310)..(310): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagnggtgtccagtgtcaggtncaacgtggaggagtcgtgggggagagtggtccagccgtgggacgtccctgacgactctcctgtacngcctntggctcaccttcattacctatggcatgcacgtggtccnccagactccgaggccgagggggctgggacgtgggtgctaggttattcaatagtgaattagggaaattggtacgtactttctacgttcaaggtaccgttcccggtaggtaacggggtcccgtacttcccgaccgttaccctaccgtaagtacgaacctaacttacccgagggtaccaacggaccgtcgttacgttacttccgtacgaactaaacgttacggaaaccgtacggtacccgtaggaacgggaagtcccgttaggggaaccgttacggaaccgggtcttggttcgttacgttaacgtggtaagtaacgtaagttatttaacgttaagttaagggg

SEQ ID NO: 409910 - DNA, 557 bp, Homo sapiens
  misc_feature: GZ8MTXP01BG7BE.11.71.G05.1.454.CMB.2.raw
  modified_base (310)..(310): a, c, t, g, unknown or other
  modified_base (352)..(352): a, c, t, g, unknown or other
  modified_base (358)..(358): a, c, t, g, unknown or other
  modified_base (421)..(421): a, c, t, g, unknown or other
  modified_base (495)..(495): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagccgtgggagtccctgagactctcctgtacagccctctggtccttcaccctttcattacctagtcggcatgcacgtgggtccnccagacctccgaggcgagggggctgggagtgggtgctagttnttcatntgatggaaattgtatacttctatcagtacctcggtagaacggtccattcaccgtctaccaganaactatccgagcacgacgctgtactctagacaaagtcgaactcgcctagagtcgctcggaaggaacgacggttntcgttgtattacgttgttgacgtaagtatttcgagtacggaggttaacgaacggtaacgggg

SEQ ID NO: 409911 - DNA, 675 bp, Homo sapiens
  misc_feature: GZ8MTXP01D6T0W.11.71.G05.1.454.CMB.2.raw
  modified_base (210)..(210): a, c, t, g, unknown or other
  modified_base (250)..(250): a, c, t, g, unknown or other
  modified_base (267)..(267): a, c, t, g, unknown or other
  modified_base (274)..(275): a, c, t, g, unknown or other
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggaggngtggtccagccgtggggagtccctgagactctcctgtacngtcctctgtctcacttnattaccnnggcatgcacgtggccncagactccgaggcgagggggctagggaggttggggtgtctaagtttatttcattagtgtaaatgggtaaaacttggttagtaacctttcgtaatttccgaaagtaccgttcccgggtgaaacggggtcccgtaattcccgacccgtctaccagtaacgtacaagttacccaggacaccgtacgtcttagtactaccgaggtactaaaagtcggaaacacggtacccgtaggacggaacgtcgtacggaacggaaccgtaaccgggtcgtttaggttagttacgtttaccgtagggttaaccgttaaggttaaaacgttcgtttaacgtaagttaacgggtaaggggtacggttaaccggggtaacgggggttaacccgtttcgg

SEQ ID NO: 409912 - DNA, 587 bp, Homo sapiens
  misc_feature: GZ8MTXP01AHMCI.11.71.G05.1.454.CMB.2.raw
  modified_base (248)..(248): a, c, t, g, unknown or other
  modified_base (296)..(296): a, c, t, g, unknown or other
  modified_base (481)..(481): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggacgtccctgagactctcctgacngcctctggccttcaccttcattacctatggcatgccacgtgggtcccncagacctccgagggccgagggggctggggagtgggggtcgctaggtttattcattagtgaagtaggaaatgtagtactttactattcgagtaccgtccggtaggaacgggcctattcccaccgtctaccagacgactaacgttccgaggtcacgacgctagtactctagggacaaagtcgaaacncgccgtgagacgcgtaggacggacgtcggctgttagtacgttacgtgtagaacgttaagttctttaagtagtaaggacggtgttacggtcggggttcgtttaacgg

SEQ ID NO: 409913 - DNA, 623 bp, Homo sapiens
  misc_feature: GZ8MTXP01A76WS.11.71.G05.1.454.CMB.2.raw
  modified_base (269)..(269): a, c, t, g, unknown or other
  modified_base (275)..(275): a, c, t, g, unknown or other
  modified_base (314)..(314): a, c, t, g, unknown or other
  modified_base (534)..(534): a, c, t, g, unknown or other
  modified_base (562)..(562): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtggggggagcgtggtccaggccgtggggacgtccctgacgactctcctgtacngcctcnggctcaccttcattacctatggcatgcacgtcgggtccnccagacctccgaggccgagggggctgggaggtggggtcgcgtagtttatttcatatgaaatagggtaatgtagtactttctaattcgaacgtaccgtccgtaggaacgggtccgacttccgacccgtacgaccgaagacgaacctaaacttccgaacggccaacggtcgtactagtacttctacgtactaaagtaccgaaacgtacgaccgtagaacggngaccgttaggaacggaccgtaccgggtnttaggttcgttacgttaacgttggtaacgaacggtaaagttagtttaacgttaagtaaggg

SEQ ID NO: 409914 - DNA, 578 bp, Homo sapiens
  misc_feature: GZ8MTXP01C6KVG.11.71.G05.1.454.CMB.2.raw
  modified_base (480)..(480): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctctttaagaggtgtccagtgtcaggtgcaactggaggagtcgtgggggagcgtggtccagcctgggagtccctgagactctcctgtacagcctctggcttcaccttcattaccctatggcatgcacgtgggtcccgcagacctccaggcgagggggctggagtgggtgcagttattcatagtgatggaaatgtgactttcattcgagtactccggtgaacgggtcgaattccaccgtctcccgtagagactaattcccgaggtacacacgctgtaatctagggacaaagtagaacagccctggagtagccgttaggaggaacccgnggtcttggttggtaactttgtaggtgttacgttaaaaggttattttaacgtaataagggtcgggtacggacgggttaacgggggttccgttttaacgg

SEQ ID NO: 409915 - DNA, 929 bp, Homo sapiens
  misc_feature: GZ8MTXP01EW61B.11.71.G05.1.454.CMB.2.raw
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgacaacgtggaggagtcggtgggggagcgtggtccaggtccgtgggacgtccctgacgtactctcctgtacacgcctcgtcggtcctctaccttctattaaccctagtcggacagttcgcctaccgttcggggtccccaccgaaggtaaccctcccggaaagggggccccgggaagggggggggggtccttaggggggtaaggttcggggggggttacggtaccgttaacgggtttttaactttttacgaaagtttaacgtaggggtaaaagtttaaggggtaaaagtttacgggtaacggtttaacccttttaccgtttaaacgtttacccggaaacgggttaacccccgtttacccgggggtaacgggtaaaccgggggtaccccgtaaacgttttacccccggaaccccggttttacccgtaaacccccggtaaagggtaaaccggtaaacccgttaaaaccgttaccccggtaaacggggaacccccgtaaaccgggtaaacccgggttacccgtttaagggttaacccttacgttaacggaaaccctaaaaagttacccgggaaaaccaacggtaccccgttaagggaaacggtaaccggaccggttaaaggggaacggaaacccggtacggggtccgttaggtttccggttaaacgtttaaccggtaggtaacggtaaaccgggtaaaatttagttttaaccggttaaggtttaaaccggggg

SEQ ID NO: 409916 - DNA, 735 bp, Homo sapiens
  misc_feature: GZ8MTXP01E13G2.11.71.G05.1.454.CMB.2.raw
  modified_base (251)..(251): a, c, t, g, unknown or other
  modified_base (374)..(374): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggaggcgtggtccagccgtgggacggtccctgagactctcctgtacngcctctgtcttcaccttcattaccatgcatcgctacgtcggtcccacacgcctaccggaggcgggacgggggtcgtagggggagggttggggtacgtacgttaagttttacttagaaattagngtaacgttaagggtaaattcggttactactttactacttcgaacgtccgtaccggacggtaccggtcctactacccgtaccgtctacgaaagaactacctaacgttcccgaacgtcccaaccgtacgtcttaacgtacctactaccgggaaactaacggtaaccgtaacgtaccggtcgtaacggaaacggtccgacgggtaacggaacccgttacgggtaccttaacgttaacggttagtttaacggttaaacgtacgggtaaacccttaaagttacgtttacgggtaaacgggtgggtaaaccggtttccggggtaaccggggttaccgtttaacccgggttaacggtttaaccccggg

SEQ ID NO: 409917 - DNA, 533 bp, Homo sapiens
  misc_feature: GZ8MTXP01E1MY6.11.71.G05.1.454.CMB.2.raw
  modified_base (272)..(272): a, c, t, g, unknown or other
  modified_base (313)..(313): a, c, t, g, unknown or other
  modified_base (359)..(359): a, c, t, g, unknown or other
  modified_base (421)..(421): a, c, t, g, unknown or other
  modified_base (448)..(448): a, c, t, g, unknown or other
  modified_base (498)..(498): a, c, t, g, unknown or other
  modified_base (507)..(507): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggtttttcctcgttgctcttttaaagaggtgtccagtgtcaggtgcaactggaggagtctggggggagcgtggtccaggccctggggacgtccctgagactctcctgtacagcctntggctcaccttcattacctatggcatgcacgtggggtcccncagactccgaggcagggggctggagtggggtgctagtttattcatngaataggaatgtgacttctattcagtacctccgtgaacgggccgattccgaccgtctccganacgacaacttccagcacgacgctgtanctgacaaatgaactagcctagagtaagcttggacgacgacgggcttgttnttataacgngtcgacgaagttacttcaagtaaggg

SEQ ID NO: 409918 - DNA, 589 bp, Homo sapiens
  misc_feature: GZ8MTXP01AMX76.11.71.G05.1.454.CMB.2.raw
  modified_base (272)..(272): a, c, t, g, unknown or other
  modified_base (313)..(313): a, c, t, g, unknown or other
  modified_base (356)..(356): a, c, t, g, unknown or other
tcagcgagagataccacgaccggtgctcgatttagtgtcgtcgcaagagagaggggggagctctgggagaggagcccagcactagaagtcggcggtgtttccattcggtgatcagcactgaacacagaggactcaccatggagtttgggctgagtcttgggttttcctcgttgcttcttttaagaggtgtccagtgtcaggtgcaacgtggaggagtcgtgggggagcgtggtccagccgtgggagtccctgacgctctcctgtacagcctntcggtctcaccttcattacctatggcatgcacgtcggtccncagactccgaggcgagggggctggacgtgggtgctagttattnatatgaataggaatgtagtactttctattcgacgtacctcggtagacggtccgtacttccgaccgtctaccgagtacgactaacttccgaggtaccacggtacgtctagtactctacgactaaatacgaacgacgtccgtagagcgcgttaggaacggaccgacggtacgttggttcgttacgtttaacgtaggtaacgtaacgtaaagtttactttaacgttaagttaaggg

SEQ ID NO: 409919 - DNA, 646 bp, Homo sapiens
  misc_feature: GZ8MTXP01BVCGA.11.71.G05.1.454.CMB.2.raw
  modified_base (247)..(247): a, c, t, g, unknown or other
  modified_base (274)..(274): a, c, t, g, unknown or other
  modified_base (293)..(293): a, c, t, g, unknown or other
tcagcgagagataccacgaccggtgctcgatttagtgtcgtcgcaagagagaggagcccagcactagaagtcggaggtgtttccattcggtgatcagcactgaacacagaggactcaccatggagtttgggctgagcttgggttttcctcgttgctcttttaagaggtgtccagtgtcaggtgcaacgtggaggagtcgtgggggagcgtggtccagccgtgggagtccctgagactctcctgtacngcctctgtcttcaccttcattacctanggcatgcacgtcgggtccncagacctccgaggcgagggggctgggagtgggtggctaggtttatttcatatgataggaaattgtcgtactttactattcgagtacctacggtggaaacggggccctattcccacccgttactacccgaagtacgaacctaacgttacccgaggtaccaccgtaccgcgttacgttattccgtaggaactaaagtacggaaacccaggccccgtaggaacggtaacgtcccgtagggaacggaccgacgggtcttacggttagttacgttcgtaggtaggttaaccgttaaagttacgtttaacgtagttaaggacgggttacggaccgggttaacggggttcgtttaaccgg

SEQ ID NO: 409920 - DNA, 592 bp, Homo sapiens
  misc_feature: GZ8MTXP01EH25M.11.71.G05.1.454.CMB.2.raw
  modified_base (348)..(348): a, c, t, g, unknown or other
  modified_base (350)..(350): a, c, t, g, unknown or other
  modified_base (359)..(359): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttccctgttgcttcttttaagaggtgtccagtgtcaggtgacaacgtgggaggagtcgtgggggagcgtggtccagccgtgggagtccctgagactctacctgtacagtcctctggctcaaccttcattacccagtcggacagtgcacgtggtccgcctagactccgaggcagggggcgtgagtggngntacgtattnatatgaagtagaagtagtagtacttactacttacacgtacgtacgtacggacggacgtactaccgtaccgtactacagaacgaacaactacacgacgacgacgtacgtacgtactactacgaacaaacgtaacgaacgtaacgacgtacgaagaacgtacgacggtacggaacgacgtacgttagttagttagttaagtagtaacgtaacgtaagttattaacgttaagtaag

SEQ ID NO: 409921 - DNA, 604 bp, Homo sapiens
  misc_feature: GZ8MTXP01ALRB7.11.71.G05.1.454.CMB.2.raw
  modified_base (250)..(250): a, c, t, g, unknown or other
  modified_base (291)..(291): a, c, t, g, unknown or other
  modified_base (331)..(331): a, c, t, g, unknown or other
  modified_base (397)..(397): a, c, t, g, unknown or other
  modified_base (424)..(424): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggaggcgtggtccagccgtgggagtccctgacgactctcctgtacngcctctgcttcaccttcattaccatgcatgcacgtcggccncagcctcgaggccgagggggctggagtgggtgctagtttnttcatgtgataggaaattggtctactttctattccgagctcccgtagggacggctactcgaccgtntaccagacgacaattccagcacacgtntgattccgaggtaacaagtacgaaacgtacgaccgtagaacgaacggtctaacgggaacggacggtaacccggtgtaacggttagttacttaacggttagtaacgttaccgttaaaggttctttaagtagttaagggacggttacgggttacgggtaaccgggggtttcgtttaaccggg

SEQ ID NO: 409922 - DNA, 660 bp, Homo sapiens
  misc_feature: GZ8MTXP01AUM8G.11.71.G05.1.454.CMB.2.raw
  modified_base (292)..(292): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagccgtgggagtccctgagactctcctgtacagcctctggcttcaccttcattacctatggcatgcacgtgggtcccnccagacctccgaggcgagggggctgggagtggggtgctaggtttattcatagtgactaggaaatagtgtacttactattcacgacgtccggtaggaacgggtccgattcccgaaccgttcctaccgaagacgaactaacgttcccgaaggcaaccgacgtcctaggtactccgtaggaaccaaaagttcgaaaaccgcgacccgtaggaacgacgtccgtagggaacggaccgtaacggggtcttaggttaggttaacttaccggttaggtaagttaaccggttaaaaggtttaccttttaacgggaagttaacggggtaaaggggtccggttaccgggggttaaccggggggttcttttaacccggg

SEQ ID NO: 409923 - DNA, 716 bp, Homo sapiens
  misc_feature: GZ8MTXP01CWQXT.11.71.G05.1.454.CMB.2.raw
  modified_base (248)..(248): a, c, t, g, unknown or other
  modified_base (294)..(294): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagccgtgggagtccctgagactctcctgtacngcctctgcttcaccttcattaccatggcatgcacgtcggggtcccnccagacctccgaggcgaggggggtctggggaggtgggggtggacgttaggtttacttttcgaattaagtggtaacgttaggggaaaatttaggttcgtaccttttaacgtaatttcgaacgtacccgttcccgggtagggaaacggggtccctattacccgtacccggtcctacgaacgaacgtaactaaacttacccgaggacccaaccgacgtaccttggtattccgtacggggaaacaaagttacgaaaccgacgtacccgtaggaacggacggtccgttagggaacggaccggtaccgggtcttacggttgttaacgtttacggtaggttacggaacgttaaaagttacgttttcgtaaagttaaggggtaacgggtacgggttaaccgggttaacggggggttccgttttaaccggg

SEQ ID NO: 409924 - DNA, 571 bp, Homo sapiens
  misc_feature: GZ8MTXP01BSOYO.11.71.G05.1.454.CMB.2.raw
  modified_base (291)..(291): a, c, t, g, unknown or other
  modified_base (354)..(354): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctcctgtacagcctctggcttcaccttcattacctatggcatgcacgtgggtcccncagacctccgaggcgagggggctggagtggggtgctagtttattcatagtgataggaaatgtnactttcattcgagaccctcgtaggaacgggccgtaattccaccgtctccgagacgactaattacccaggcacacgctggtatctaggactaaatcgaacagcccgtgacgagcgtaggacggaacgcggtcttggttagtacttacgtggtacgacggttaaagttagtttctaagtggtaaggtacggttacgggtaacgggggttcgtttaacgg

SEQ ID NO: 409925 - DNA, 627 bp, Homo sapiens
  misc_feature: GZ8MTXP01CC83F.11.71.G05.1.454.CMB.2.raw
  modified_base (164)..(164): a, c, t, g, unknown or other
  modified_base (296)..(296): a, c, t, g, unknown or other
  modified_base (508)..(508): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagnggtgtccagtgtcaggtgcaactggaggagtcgtggggggaggcgtggtccagcctgggagtccctgagactctcctgtacagcctctcggcttctaccttcattaccctatggcatgccacgtcggtcccncagacctccgaggcgacgggggctgggacggtggggtcggactagtttatttcaattagtagtataggtaaaatggttacgtactttacttaattcgaacgtaccgttacccgggtaggaaacggggtcccgtattaccgacccggttctacccaaggtaacactaaactcccgaaggccacgacgtctagtactctgactaaagtcgaacncggtccaggacgtacgcgtaggtaggaaccgtcgggtcttaaggttgtttaacgttcgtaggtgaacggttaagttctttaagacgtggtaggtcggacggttcgggggttgtttccgg

SEQ ID NO: 409926 - DNA, 588 bp, Homo sapiens
  misc_feature: GZ8MTXP01A890B.11.71.G05.1.454.CMB.2.raw
  modified_base (274)..(274): a, c, t, g, unknown or other
  modified_base (453)..(453): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtggggagtccctgacgactctcctgtacagcctctggcttcaccttcattacctanggcagtgcacgtcgggtcccgcagacctccgaggcggagggggctgggaggtgggtgctagtttatttcgatagtgtaacgtggaaatgtgtacctttactattcgaagtaccgtcggtaggacgggcctagttccaccgtctaccagacacactaccaggacacacgtctgtactacnggaactaaagtacgaacgacgccgtagagacgcgtacggaggacgacggtcgtgttagtagttagtcggtagaacgttaattagttaacgtagtaaggtagggtcggttacggttaacgggggttcgtttaacgg

SEQ ID NO: 409927 - DNA, 575 bp, Homo sapiens
  misc_feature: GZ8MTXP01AIGMG.11.71.G05.1.454.CMB.2.raw
  modified_base (248)..(248): a, c, t, g, unknown or other
  modified_base (253)..(253): a, c, t, g, unknown or other
  modified_base (267)..(267): a, c, t, g, unknown or other
  modified_base (276)..(276): a, c, t, g, unknown or other
  modified_base (294)..(294): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggagtccctgagactctcctgtacngcctntggcttcacccttnattacctanggcatgcacgtgggtccnccagcctccgaggcgagggggctgggaggtgggtggctagtttattcatatgatggaaatgtgacttctattcagtaccgttcggtagaacggggtcctattccacccgtctaccagacactaattccaggcacacgctagtatcgtaggacaaagtgaaacacgccgtagacgtacgctagggaacggacgcggtctggttggtacttacgtgtacgttacgttaaagttatttaacaagtcggtagggtggttacggtaacgggggttcgtttaaccgg

SEQ ID NO: 409928 - DNA, 619 bp, Homo sapiens
  misc_feature: GZ8MTXP01A6UI8.11.71.G05.1.454.CMB.2.raw
  modified_base (183)..(183): a, c, t, g, unknown or other
  modified_base (270)..(270): a, c, t, g, unknown or other
  modified_base (275)..(275): a, c, t, g, unknown or other
  modified_base (318)..(318): a, c, t, g, unknown or other
  modified_base (401)..(401): a, c, t, g, unknown or other
  modified_base (544)..(544): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagnggtgtccagtgtcaggtgcaacgtggaggagtcgtgggggagcgtggtccaggcccgtggggacgtccctgacgtactctcctgacngcctntgcctcaccttcacttacctatggcatgccacgtcgggtcccnccagaccctccgaggcgagggggctgggaggtggggtgctaggtttatttgatatgaaatagggtaaattggtacgtactttntattcgaagtccgtccggtaggaacgggtccgtacttccgacccgtactacccgaagtaacgaccttaaacgttccgaagggtcccaacggacgtcgttacgtactcgtacgaacaaagtcgaaactcgaccgtgaagaacgngaggacggcgaggtcttaggttgttacgtaagtggtaacgtaacggtaagttacgtttaacgttaaggtaacggg

SEQ ID NO: 409929 - DNA, 561 bp, Homo sapiens
  misc_feature: GZ8MTXP01BU4TV.11.71.G05.1.454.CMB.2.raw
  modified_base (491)..(491): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtggggggaggcgtggtccagccgtgggaggtccctgagactctcctgtacagcctctggcttcacccttcattaccctatggcatgcacgtgggtcccgccagactccaggcaggggggctgggaggtggggtggctagtttattcatatgatggaaatgtgacttctattcagtacctccggtagaacgggtccattccaccgtctccagagactaacttccaggacacacgctgtatctgggacctaaagtcgaacagcccgtgagagctgagacaggctgttgtattacgngtacgacgttaaagttctttaactagtaacggagggttcgacggggttaaccggggttcgttttaaccgg

SEQ ID NO: 409930 - DNA, 567 bp, Homo sapiens
  misc_feature: GZ8MTXP01ADQ73.11.71.G05.1.454.CMB.2.raw
  modified_base (246)..(246): a, c, t, g, unknown or other
  modified_base (251)..(251): a, c, t, g, unknown or other
  modified_base (262)..(262): a, c, t, g, unknown or other
  modified_base (270)..(270): a, c, t, g, unknown or other
  modified_base (288)..(288): a, c, t, g, unknown or other
  modified_base (320)..(320): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagcctgggagtccctgagactctcctgtacngcctntgcttcacttnattaccanggcatcgcacgtgggccncagactccgaggcgagggggctgggagtgggngctagttattcatatagataggaaatgtgtaactttctattcagtacctcggtagaacgggtcctattccaccgtcaccagtacgaactacttaccgacggacacgacgtctagtactctacggataaacgtgaaacgacgcctaggagagacgtaggacggacgacggtctggttagtacttagtgtagacgttaagttatttaacgagtaacgtagggtacgacggtaacggggttcgtttaacg

SEQ ID NO: 409931 - DNA, 568 bp, Homo sapiens
  misc_feature: GZ8MTXP01A0BHH.11.71.G05.1.454.CMB.2.raw
  modified_base (264)..(264): a, c, t, g, unknown or other
  modified_base (286)..(286): a, c, t, g, unknown or other
  modified_base (313)..(313): a, c, t, g, unknown or other
  modified_base (381)..(381): a, c, t, g, unknown or other
  modified_base (429)..(429): a, c, t, g, unknown or other
  modified_base (455)..(455): a, c, t, g, unknown or other
  modified_base (472)..(472): a, c, t, g, unknown or other
  modified_base (533)..(533): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggtttttccctcgttgcttcttttaagaggtgtccagtgtcaggtgcaacgtgggaggagtcgtgggggagcgtggtccagccgtgggacgtccctgagactctccngtacagcctgtggctcaccttnattacctatgcatgcacgtcgggtccncagactccgaggcgagggggctgggaggtggggtgctagtttactttacatagtgaaataggaattgngtaacttctattcaagtcctcgtagacgggcattccacgtctcagganacaactcgacgcacgaacgctcgtancgtgacaaatcgaaacncggacctaggacgtaagcgttagggaacgacggtaacggcgttaggttcttagtttaacgngttaacggcgtaaaggttattccgttaagtaaggg

SEQ ID NO: 409932 - DNA, 595 bp, Homo sapiens
  misc_feature: GZ8MTXP01AOQE2.11.71.G05.1.454.CMB.2.raw
  modified_base (184)..(184): a, c, t, g, unknown or other
  modified_base (267)..(267): a, c, t, g, unknown or other
  modified_base (272)..(272): a, c, t, g, unknown or other
  modified_base (291)..(291): a, c, t, g, unknown or other
  modified_base (312)..(312): a, c, t, g, unknown or other
  modified_base (336)..(336): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggtttttcctcgttgcttcttttaagnggtgtccagtgtcaggtgcaacgtgggaggagtcgtgggggagcgtggtccagcctggggacgtcctggagactctcctgacngcctnggctcacttcattacctancggcatgccacgtcgggtccncagactccgaggccgagggggtcngggacgtggggtcgctagtttattacatagtgtaaacgtaggaaattggtgtacctttactattacgaagtcccgtacgtaggaacgggcctacgttccaccgtttcaccagtacgaactaacgtaccaggtcaccgacgtaccttagacttcacgacaaattacgaaacacggtaccaggacggaacgcgttggacggacgacgtcgttggttcttagttgtaggttcgaaggtaagttagtttcgttaaggtaaggg

SEQ ID NO: 409933 - DNA, 787 bp, Homo sapiens
  misc_feature: GZ8MTXP01EPR1Y.11.71.G05.1.454.CMB.2.raw
  modified_base (312)..(312): a, c, t, g, unknown or other
tcagcgagagataccacgaccggtgctcgatttagtgtcgtcgcaagagagaggagccccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggacgtccctgacgtactctcctgtacacgtcctcgtggtccttctacccttctacttacctagtggctatcgctacgtcgggtcccnccagaccctccggaggcggaagggggtctgggtaggtggggtcgtacttagtttatttcaagttataggaattaaggtaaatcggttacgtacctttacgttaactctaacggtaaccgtccgggtaacggaacgggtcccgtattcccgtacccgttagtacccgtaaggtactaacctaacttacccgaacggtacaacccgtcgttacctggttaaactctaacgggtaactaaaacgttaaccgaaacgaacgttacccgagggacgtaaaccggcgttaaacgggaaccggtaaacccggtccgggtcgttttaagggttaacgttttaaaccgtttacggtacgggttaaaggttaaaccggttaaaaattttacggttttaaacccgtaaggttaaacccggggggttaaggtaaccggggtttaacccgggggttaaccgggggttttaaccgttttaacccggggg

SEQ ID NO: 409934 - DNA, 504 bp, Homo sapiens
  misc_feature: GZ8MTXP02JCKLN.11.71.G05.1.454.CMB.2.raw
  modified_base (288)..(288): a, c, t, g, unknown or other
  modified_base (349)..(349): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggtttcctcgttgctctttaagaggtgtccagtgtcaggtgcaactggaggagtctgggggaggcgtggtccagcctgggaggtccctgagactctcctgtacagcctctggcttcaccttcattaccctatggcatgcactgggtccnccagactccaggcaggggctggagtgggtgcagttattcatatgatggaaatagtgacttnattcagactccgtgaagggccattcaccgtctccagagacaattccaggcacacgctgtatctgcaaatgaacagcctgagagctgaggacacggctggtgtattactgtgacgtaaagtatttctagtagaggtgacgtacgggggtcgtttcg

SEQ ID NO: 409935 - DNA, 524 bp, Homo sapiens
  misc_feature: GZ8MTXP02I8R5Y.11.71.G05.1.454.CMB.2.raw
  modified_base (289)..(289): a, c, t, g, unknown or other
  modified_base (382)..(382): a, c, t, g, unknown or other
  modified_base (388)..(388): a, c, t, g, unknown or other
  modified_base (434)..(434): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtgggtttcctcgttgctctttaagaggtgtccagtgtcaggtgcaactggaggagtcgtgggggaggcgtggtccagcctgggaggtccctgagactctcctgtacagcctctggcttcaccttcattacctatggcatgcactgggtccnccagactccaggcaggggctggagtgggtgcagttattcatatgatggaaatgtgacttcattcagactccgtgaaggggccattccaccgtntccagngacaattcccaggcacacgctgtatctgacaaaatcgaacagaccngagagcgagaggacgacgacgtgtagtacgttagtacgtagtacgaagtattaacgttagtagtaggtaggtacggtacgggtacggtcg

SEQ ID NO: 409936 - DNA, 517 bp, Homo sapiens
  misc_feature: GZ8MTXP02H7KOB.11.71.G05.1.454.CMB.2.raw
  modified_base (310)..(310): a, c, t, g, unknown or other
  modified_base (375)..(375): a, c, t, g, unknown or other
  modified_base (421)..(421): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagttgggctgagctgggttttcctcgttgcttcttttaagaggtgtccagtgtcaggtgcaactggaggagtcgtgggggaggcgtggtccagcctggggagtccctgagactctcctgtacagcctctggccttcaccttcattacctatggcatgcacgtgggtcccnccagactccgaggcgagggggctggagtggggtgctagttattcatatgataggaatgtgacttnattcagtactccgtgaggccatcacgtctccagagacatcagcacncgctgtatctagacaaatcgaaacacgacctagacgagcgtaggacggacgacggtctgtgtattaacgtgtagacgtaaaagtctttactagtag

SEQ ID NO: 409937 - DNA, 508 bp, Homo sapiens
  misc_feature: GZ8MTXP02I9NCY.11.71.G05.1.454.CMB.2.raw
  modified_base (306)..(306): a, c, t, g, unknown or other
  modified_base (442)..(442): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtctgggggagcgtggtccagcctgggagtccctgagactctcctgtacagcctctggcttcaccttcattacctatggcatgcactgggtcccncagactccaggccaggggctgggagtgggtggcagttatttcatatgatgaatgtgacttcattcagactccgtgaaggccgagttcaccgtctccagagacaattcaggcacacgctgtatctgacaatgaaacngcctgagagctagacggacacggctagtgtattaacgtgtagacgtaaagtactttactagtaagg

SEQ ID NO: 409938 - DNA, 516 bp, Homo sapiens
  misc_feature: GZ8MTXP02HAQB7.11.71.G05.1.454.CMB.2.raw
  modified_base (304)..(304): a, c, t, g, unknown or other
  modified_base (419)..(419): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggagcgtggtccagcctgggagtccctgagactctcctgtacagcctctggcttcaccttcattacctatggcatgcactgggtccnccagactccgaggcgaggggctgggagtggggtgcagttattcatatgatgggaatgtgacttctattcagactccgtgaaggccatcaccgtctccagagacattccaggcacncgctgtatctgacaaatcgaactgcctagacgacgcgtaggacggacacggtctggtgttattaacgtgtacgacgtaaaagtctttactagtaagg

SEQ ID NO: 409939 - DNA, 518 bp, Homo sapiens
  misc_feature: GZ8MTXP02HJLVS.11.71.G05.1.454.CMB.2.raw
  modified_base (429)..(429): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctggggagggcgtggtccgagcctgggaggtccgtcgagactctcctcgtacagcctctggcttcaccttcatacctactggcatgcactgggtccgccagactccaggcgaggggcgtggaggtggggtgggcgagttagtttcatatgataggaaatagtgtacttcttatcagactccgtgaagggccgattcaccgtctcccagagacaaattccaggcacacgctgtanctgcaaatgacagcctgagagctgaggacacggtctgtgtattactgtgacgaaagtatttctatagacggtgacgtacgggggcgttc

SEQ ID NO: 409940 - DNA, 538 bp, Homo sapiens
  misc_feature: GZ8MTXP02I2O43.11.71.G05.1.454.CMB.2.raw
  modified_base (290)..(290): a, c, t, g, unknown or other
  modified_base (348)..(348): a, c, t, g, unknown or other
  modified_base (442)..(442): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcactgggtccnccagactccaggcgagggggctggagtggggtgcagttattcatatgatggaaatgtnacttctattcagtactccgtagaacgggcctattccaccgtctccagagacaattccagcacacgctgtatctagacaaatgaacagcctgagngctgacggacacggtctgtagtattacgtgtagtacgaaaagtactttaagtaaggtaagggtacggtacggtacggggtacggggtactttacgg

SEQ ID NO: 409941 - DNA, 509 bp, Homo sapiens
  misc_feature: GZ8MTXP02G28V0.11.71.G05.1.454.CMB.2.raw
  modified_base (308)..(308): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggaggagtcgtgggggaggcgtggtccagcctggggagtccctgagactctcctgtacagcctctggcttcaccttcattacctatggcatgcactgggtccnccagactcaggcagggggctggagtgggtggcagttattcatatgatggatgtgacttctattcagactccgtgaaggcatcaccgtctccagagacattccaggcacacgctgtatctagacaaatgaaacagacctagagacgctagacgacgacggctagtgtattaacgtgtagacgtaaagtatttacgtataagg

SEQ ID NO: 409942 - DNA, 607 bp, Homo sapiens
  misc_feature: GZ8MTXP02HITLN.11.71.G05.1.454.CMB.2.raw
  modified_base (293)..(293): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcggtggtccaggcctgggaggtccctgagactctcctgtacagcctctggcttcaccttcattacctatggcatgcacgtgggtccnccagacctccgaggcgagggggctgggagtgggtggctagttattcatatgatggaaatgtgacttctattcagtactccggtagaacgggccgaatttcccgacccgttctcccagacgaactaacttcccaagggccaaccgaccggtctcggttaactccgttagacctaaaagtcgaaaaccgacggaccctaggaaggacgtcctagggaaacgggaccgacgggtcgttaggtgttaacttaccgtggtacgaacgtaaagtatttaagaagtaaggtaggtacgacgggttacggggtacgtttacg

SEQ ID NO: 409943 - DNA, 528 bp, Homo sapiens
  misc_feature: GZ8MTXP02IIC0O.11.71.G05.1.454.CMB.2.raw
  modified_base (290)..(290): a, c, t, g, unknown or other
  modified_base (476)..(476): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagcctgggaggtccctgagactctcctgtacagcctctggcttcacttcattaccatggcatgcacgtgggtcccnccagacctccgaggcgagggggctgggagtgggtgctagttattcatatgataggaaatgtgacttctattcagtactccggtagaacggggcctattccaccgtctccagagacaattcacggcacacgctgtatctagacaaatgaacagcctagagagctgagacacggctagtatacttacngtacgaacgtaatattaagtaagtagtacggtagtacggtacggggtactcg

SEQ ID NO: 409944 - DNA, 524 bp, Homo sapiens
  misc_feature: GZ8MTXP02HYB1Z.11.71.G05.1.454.CMB.2.raw
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcacgtgggtccnccagactccgaggcagggggctggagtgggtgctagttattcatatgataggaaatgtgacttctattcagtactccgtagaaggggccattccaccgtctccagagacaattccaggcacacgctgtatctgacaaatgaacagacctagacgagctagacggacacggctgtagtattacgtgtgacgtaaagtatttgtaagtacggaggtagacgtacgggggtcttcg

SEQ ID NO: 409945 - DNA, 497 bp, Homo sapiens
  misc_feature: GZ8MTXP02JI5D3.11.71.G05.1.454.CMB.2.raw
  modified_base (289)..(289): a, c, t, g, unknown or other
  modified_base (318)..(318): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccnccagactccaggcaggggctggagtgggngcagttattcatatgatggaaatgtgacttctattcagactcgtagaagggccattcacgtctccagagacaattccaggcacacgctgtatctgacaatgaacagcctagagagctgagacacggctagtgtatactgtgacgaagtattcgagtagaggtgacgtacggggcttacg

SEQ ID NO: 409946 - DNA, 537 bp, Homo sapiens
  misc_feature: GZ8MTXP02J07OW.11.71.G05.1.454.CMB.2.raw
  modified_base (291)..(291): a, c, t, g, unknown or other
  modified_base (471)..(471): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattaccctatggcatgcactgggtccnccagacctccaggcagggggctggagtggggtggcagttattcatatgatggaaatgtgacttctattcagactccgagaagggccgattccaccgtctctagagacaattccaggccacacgctgtatctgacaatgaacagcctgagagctaggaggacacggctgtagtacttacgngttagacgtaaaggtatttaacgtaagtacggaggttacggtaccggtacgggggtcgtttaccgg

SEQ ID NO: 409947 - DNA, 516 bp, Homo sapiens
  misc_feature: GZ8MTXP02HJMNZ.11.71.G05.1.454.CMB.2.raw
  modified_base (301)..(301): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagcctggggagtccctgagactctcctgtacagcctctggcttcaccttcattacctatggcatgcactgggtccnccagactccaggcagggggctggagtgggtgcagttattcatatgatggaaatgtgacttctattcagactccgtgaaacgggtccattcaccttctccagagacattccaggcacacgctagtatctgacaaatgaacagcctgagagctgaggacacggctgtgtattacgtgtagacgaaagtatttactatagacggtagacgtacggggg

SEQ ID NO: 409948 - DNA, 522 bp, Homo sapiens
  misc_feature: GZ8MTXP02F2UVD.11.71.G05.1.454.CMB.2.raw
  modified_base (294)..(294): a, c, t, g, unknown or other
  modified_base (429)..(429): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtgggtttcctcgttgctctttaagaggtgtccagtgtcaggtgcaactggaggagtcgtgggggaggcgtggtccagccgtgggacggtccctgagactctcctgtacagcctctggcttcacccttcattacctatggcatgcacgtgggtcccnccagacctccgaggcgagggggctgggagtggggtgcagtttattcatatgataggaaatgtgacttctattcagactccgtagaacgggccattccaccgtctccagacgacaattccagcacacgctgtatcngacaaatcgaacagccagagagcgagagacgacgcgtgtagtactatgtacgacgaagtattaatagtagtagtagacgtacgggtacgttcg

SEQ ID NO: 409949 - DNA, 559 bp, Homo sapiens
  misc_feature: GZ8MTXP02IPWW2.11.71.G05.1.454.CMB.2.raw
  modified_base (356)..(356): a, c, t, g, unknown or other
  modified_base (401)..(401): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtgggtttcctcgttgctctttaagaggtgtccagtgtcaggtgcaactggaggagtcgtgggggagcgtggtccagccgtgggagtccctgagactctcctgtacagcctctggccttcaccttcattacctatggcatgcacgtgggtcccgccagacctccgaggcgagggggctgggagtggggtgctagttattcatagtgataggaaatcgtntacttctattcagtacctccgtagaacgggtccattcccacgtcnccagacacgtaattccaaggcaacgacgctgtatctagactaaatgaacagcctagagagcgtagacgacgacggtcgtgttagtacgttacgtggtacgaacgtaagttacttaacgtagtacggtacggtacggtacggttacggggtacgtttcg

SEQ ID NO: 409950 - DNA, 559 bp, Homo sapiens
  misc_feature: GZ8MTXP02FYGX5.11.71.G05.1.454.CMB.2.raw
  modified_base (312)..(312): a, c, t, g, unknown or other
  modified_base (354)..(354): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagttgtcaggtgcaacgtggaggagtcgtgggggagcgtggtccagccgtgggacgtccctgagactctcctgtacagcctctggcttcaccttcattaccatggcatgcacgtcgggtccncagacctccgaggcgaggggctggagtgggtgctagttattnatatgataggaatgtcgtacttctattcgagtacgtaccgtaggaacggtccgtaattccacccgttctacccaaggaacaactaacgttaccgaggccaacgacgtcttagtaactctacgacaaagtagaacacgaccgagagacgacgagagacgacgtcgtgtagtataacgtagtacgacgtaagtacttactagtaagg

SEQ ID NO: 409951 - DNA, 527 bp, Homo sapiens
  misc_feature: GZ8MTXP02ISH4M.11.71.G05.1.454.CMB.2.raw
  modified_base (292)..(292): a, c, t, g, unknown or other
  modified_base (326)..(326): a, c, t, g, unknown or other
  modified_base (354)..(354): a, c, t, g, unknown or other
  modified_base (359)..(359): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggaggcgtggtccagcctgggagtccctgagactctcctgtacagcctctggcttcaccttcattacctatggcatgcacgtgggtcccnccagacctccgaggcgagggggctgggagtgggngctagttattcatatgataggaaatgtnacttntattcagactccgtgaaggcattccaccgtctccaagagacaattccaggacaacacgctgtatctagacaaatagaacaacgacctagagagacgagaggacgacgacgtgtgtactatagtagacgaagattaatataagtaagtagacgtacgggtacggttacg

SEQ ID NO: 409952 - DNA, 543 bp, Homo sapiens
  misc_feature: GZ8MTXP02GE24E.11.71.G05.1.454.CMB.2.raw
  modified_base (290)..(290): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtcccnccagacctccaggcgagggggctgggagtgggtgctagttattcatatgataggaaatagtgacttctattcagtactccggtagaacgggcctattcaccgtctccagagacaattccaggcacacgctgtatctgacaaatgaaacagcctgagagcgtaggacggacgacggcgtaggtagttacgttactggtacgacgtaaagtattaacgtaagtacggaggtagtacggtacgggggtcgtttacg

SEQ ID NO: 409953 - DNA, 527 bp, Homo sapiens
  misc_feature: GZ8MTXP02F6OT3.11.71.G05.1.454.CMB.2.raw
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcacgtgggtccnccagacctccaggcgagggggctgggagtggggtggctaggtttattcatatgatggaaatgtgtacttctattcagactccgtagaagggccattcaccgtctccagagacaattccaggcacacgctagtatctgacaaatgaaacagcctagagagctgaggacgacggctgtgtattacgtgtacgacgaagtattaacgtataggaggtgacggtacgggggtctttacgg

SEQ ID NO: 409954 - DNA, 536 bp, Homo sapiens
  misc_feature: GZ8MTXP02FJICN.11.71.G05.1.454.CMB.2.raw
  modified_base (309)..(309): a, c, t, g, unknown or other
  modified_base (415)..(415): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggagtccctgagactctcctgtacagcctctggccttcaccttcattacctatggcatgcacgtgggtccnccagacctccgaggcgagggggctgggagtggggtggctagtttatttcatatgataggaatgtgacttctattcagtactccgtgaacggccgtattcaccgtcnccagagacaactccaggcacacgctgtactctagacaaatgaacagcctagacgacgcgtaggacggacgacgggcttgtgttattaacgtgtacgacgtaaagtatttacgtagtaaggg

SEQ ID NO: 409955 - DNA, 556 bp, Homo sapiens
  misc_feature: GZ8MTXP02JYT58.11.71.G05.1.454.CMB.2.raw
  modified_base (257)..(257): a, c, t, g, unknown or other
  modified_base (262)..(262): a, c, t, g, unknown or other
  modified_base (477)..(477): a, c, t, g, unknown or other
  modified_base (488)..(488): a, c, t, g, unknown or other
  modified_base (505)..(505): a, c, t, g, unknown or other
  modified_base (530)..(530): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggagcgtggtccagccgtgggacgtccctgagactctcctgtacngcctntggcttcaccttcattacctatggcatgcacgtgggtccgccagacctccgaggcgaggggctggaggtgggtgctagtttattcattagtgataggaaatggtgactttctattcagtactccgtaggaaacgggccctattcccgaccgtcctcccgaagacgaactaacttccgaggtccacacgtctgttactctagactaaatcgaaacngacctagacgngacgagaggacgacggntcgtgtatacgtgtacgagaagttntttcagtgaggtcgacggttacgggg

SEQ ID NO: 409956 - DNA, 530 bp, Homo sapiens
  misc_feature: GZ8MTXP02JWMTD.11.71.G05.1.454.CMB.2.raw
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcacgtgggtccnccagacctccaggcgagggggctgggaggtggggtggctaggttatttcatatgatggaaatgtgacttctattcagactccggtagaagggccattccaccgtctccagagacaatccaggcacacgctgtatctagacaaatgaacagcctgacgagctaggaggacacggctgtagtacttacgtgtagacgaagtattaacgtagtagtaggtagacggtacgggggtctttacg

SEQ ID NO: 409957 - DNA, 551 bp, Homo sapiens
  misc_feature: GZ8MTXP02JAIW2.11.71.G05.1.454.CMB.2.raw
  modified_base (261)..(261): a, c, t, g, unknown or other
  modified_base (287)..(287): a, c, t, g, unknown or other
  modified_base (307)..(307): a, c, t, g, unknown or other
  modified_base (334)..(334): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcgtggtttcgtcgtaggctctttaagaggtgtccagtgtcaggtgcaactggaggagtcgtgggggaggcgtggtccagcctgggaggtccctgagactctcctgacngcctgtgcttcaccttctattacctntgcatgcacgtcgggtcccncacgacctcgaggcggaggggctgggnggtgggtgctagttattcatagtgagtagaatgtacgtacttctatcgagtacctcgtaggaacggtccgtagttccgtaccgtctaccagacgaactacgtcgagaccaacgacgtctagtactactacgacgaatacgaacacgacgagagacgacgagacgacgacgtcgtacgtagtagttaagtacgtacgacgtaagtacttacgtagtag

SEQ ID NO: 409958 - DNA, 522 bp, Homo sapiens
  misc_feature: GZ8MTXP02HIIOC.11.71.G05.1.454.CMB.2.raw
  modified_base (309)..(309): a, c, t, g, unknown or other
  modified_base (409)..(409): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagcctgggaggtccctgagactctcctgtacagcctctggcttcaccttcattacctatggcatgcacgtgggtcccnccagacctccggggcagggggctgggagtggggtgctagttacttcatatgatggaaatgtgacttctattcagactcgtgaaggcatcacgtctcaganaacatccagcacacgctgtatctagacaaatagaacacgacctagagagacgtagaggacgacggacgtcgtacgtattagtaagtgacgtaaagtaattactagtagtaagg

SEQ ID NO: 409959 - DNA, 533 bp, Homo sapiens
  misc_feature: GZ8MTXP02JEFE2.11.71.G05.1.454.CMB.2.raw
  modified_base (289)..(289): a, c, t, g, unknown or other
  modified_base (350)..(350): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattaccatggcatgcactgggtccnccagactccaggcgagggggctggagtgggtggctagtttattcatatgatggaaatagtnactttctattcagtactccgtagaagggccattcaccgtctcccagagacaattccaggcacacgctgtatctgacaaatgaacagcctagaggagcgaggaggaacgacggcgtgtaggttattacgtgtgaacgtaaagtatttctaagtaggtaggtacggtacgtacgggggtctttcg

SEQ ID NO: 409960 - DNA, 582 bp, Homo sapiens
  misc_feature: GZ8MTXP02HKAPG.11.71.G05.1.454.CMB.2.raw
  modified_base (289)..(289): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagctctcctgtacagcctctggcttcaccttcattacctatggcatgcactgggtccnccagactccgaggcgagggggctgggagtggggtgcagtttattcatagtgataggaaatgtgtacttctatcagtactccgtgaacggggccattcaccgtctaccgagacgacaacttccgaggcacacgtctgtactcgtagactaaatcgaaacgtacgccgtaggacgacgacgtaggaacgggaacaccgggtcttaggttagttaactttacgtcggtacgaacggtaaaattacgtttaacgtaagtacgggtaaggtcgtaaccgggttacgggggtctttacg

SEQ ID NO: 409961 - DNA, 572 bp, Homo sapiens
  misc_feature: GZ8MTXP02I53BM.11.71.G05.1.454.CMB.2.raw
  modified_base (245)..(245): a, c, t, g, unknown or other
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctcctgtacngcctctggcttcaccttcattacctatggcatgcactggggtcccnccagactccgaggcgagggggctgggagtgggtggctagttattcatatgatggaaattgtgacttctattcagacttccgtagaacgggcctattccaccgtctccagacgacaattccaggcacacgctagtactctgacaaatgaaacacgccctagacgagcgtaggaacggacgaacggtcgttaggttagttacgtttaacgtggttacgtacggtaaaagttatttaacgtaagttaaggacgggttagtaaccggttacgggggtacgtttcg

SEQ ID NO: 409962 - DNA, 539 bp, Homo sapiens
  misc_feature: GZ8MTXP02JZYQ9.11.71.G05.1.454.CMB.2.raw
  modified_base (301)..(301): a, c, t, g, unknown or other
  modified_base (362)..(362): a, c, t, g, unknown or other
  modified_base (368)..(368): a, c, t, g, unknown or other
  modified_base (436)..(436): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagttgggctgagctgggttttcctcgttgctcttttaagaggtgtccagtgtcaggtgcaactggaggagtcgtgggggaggcgtggtccagccgtgggacggtccctgagactctcctgtacagcctctggcttcaccttcattacctatggcatgcacgtggcccncagactccgaggcgaggggctgggaggtgggtggctagttattcatatgataggaaatgtntacttntattcagtactccgtagaacgggccgtattcaccgtctccagacacatccgagcacacgctagtatcngacaaatcgaacacgacctgagagacgtagacggacgacggctgtagttagtacgtgtagaacgtaaagtattactagtaggtaggtacgtacggtacggggg

SEQ ID NO: 409963 - DNA, 529 bp, Homo sapiens
  misc_feature: GZ8MTXP02I35GK.11.71.G05.1.454.CMB.2.raw
  modified_base (289)..(289): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccnccagacctccaggcagggggctggagtgggtggcagttattcatatgatggaaatgtgacttctattcagactccgtgaacgggcattcaccgtctccagagacaattccaggcacacgctgtatctagactaaatgaacagccgtagagagctggaggacacgggctggtacgttattacgtgtagacgtaaagtatttaacgtagtagtagggtacgtacggtacgggggtctttacg

SEQ ID NO: 409964 - DNA, 692 bp, Homo sapiens
  misc_feature: GZ8MTXP02JK75W.11.71.G05.1.454.CMB.2.raw
  modified_base (289)..(289): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatgcatgcactgggtccnccagctccgaggcgaggggctgggagtggggtggctagttattcatagtgataggaaatgtgtacttctatttcgagtaccgtccggtaggaaacggggtcccgtaattcccacccggttcctacccgaagacggaaccctaaacgtttcccgaacggggtaccaacccgaaccgtaccgttaggtacttaccgttggaacctaaaattaccgggaaaacctaacggtaccccgttaggaacggtacggaccgtagggaaacgggaaccgaaccggggtccgttagggttaggttaacgtttaaccggttggttacggaaccgttaaaaggttattttaacgtaaaggttaacgggtaaggggtacggtaaccgggtttaaccggggggtcgttttaaccggg

SEQ ID NO: 409965 - DNA, 575 bp, Homo sapiens
  misc_feature: GZ8MTXP02GERVD.11.71.G05.1.454.CMB.2.raw
  modified_base (256)..(256): a, c, t, g, unknown or other
  modified_base (301)..(301): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggagtccctgagactctcctgtacngcctctggcttcaccttcattacctatggcatgcacgtgggtccnccagacctccgaggcgagggggctgggagtgggtgctagttattcatatgataggaaatgtgtacttctattcagtacctccgtagaacgggcctattcaccgtctaccagacgacacttcaggcacacgctgtatctagacaaatgaaacagcctagagacgacgtaggaacggacgtacgggcttaggttacggtatttaccgtcggtagtaacggtaaaagttacttttacgtaagttaaggtagggttacggtaaccggtttaacggggg

SEQ ID NO: 409966 - DNA, 575 bp, Homo sapiens
  misc_feature: GZ8MTXP02JADCN.11.71.G05.1.454.CMB.2.raw
  modified_base (295)..(295): a, c, t, g, unknown or other
  modified_base (449)..(449): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcgaggtgcaacgtggaggagtcggtgggggagcgtggtccaggcctgggacgtccctgagactctcctgtacagcctctggcttcaccttcattaccatggctatgcacgtgggtcccnccagacctccgaggcgaggggctgggaggtggggtgctagtttattcatagtgagtaggaaattgtgtacttctattcgaagtcctccggtagaacgggcctattcccaccgtctccgagacgactactccgaggcacgacgctagtactctanactaaatacgaacagcctaggagagcgtaggacggaccgacggtacgtggtacgttacttacgtcggtacgaacgtaagtatttaacgtaagtaggtaggtagacgggttacgggggtctttacgg

SEQ ID NO: 409967 - DNA, 533 bp, Homo sapiens
  misc_feature: GZ8MTXP02JT3A6.11.71.G05.1.454.CMB.2.raw
  modified_base (290)..(290): a, c, t, g, unknown or other
  modified_base (351)..(351): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcactgggtccnccagacctccaggcgagggggctgggagtgggtgctaggttattcatatgatggaaatgtntacttctattcagactccgtgaacgggccgattccaccgtctccagacgacaattccagcacacgctgtatctgacaaatgaacagcctagagagctggaggacacggctggtagtattacgtgtacgacgtaaagttatttaacgtagtacggaggttcgacggttacgggggcgtttacg

SEQ ID NO: 409968 - DNA, 556 bp, Homo sapiens
  misc_feature: GZ8MTXP02H1DSO.11.71.G05.1.454.CMB.2.raw
  modified_base (290)..(290): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcactgggtccnccagactccaggcagggggctggagtgggtgcagttattcatatgatggaaatgtgacttctattcagtactccgtagaacgggccgtattccacccgtctacccgaagaacgaacaacttccgaaggaccacaaccgtctagtactcgtgactaaaatgaaacagtccagagagcgtaggacggacgacggtctaggtagtaattacgtgtacgacgtaaagtctttaagagtaacggaggtagacggtacgggggtctttacgg

SEQ ID NO: 409969 - DNA, 527 bp, Homo sapiens
  misc_feature: GZ8MTXP02JYQZB.11.71.G05.1.454.CMB.2.raw
  modified_base (377)..(377): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcactgggtcccgccagacctccgaggcgagggggctgggaggtggggtggctagttattcatatgataggaaatgtgtacttctattcagtactccgngaagggccattcaccgtctccagacgacatccaggcacacgctgtactctgacaaatgaacagcctgagagcgtgacggacacggctggtgtattacgtgtgacgtaaagtattaagtagtaggaggtagacggtacgggggctttacgg

SEQ ID NO: 409970 - DNA, 536 bp, Homo sapiens
  misc_feature: GZ8MTXP02JVCVC.11.71.G05.1.454.CMB.2.raw
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcacgtgggtccgccagactccaggcagggggctgggaggtggggtggctagtttatttcatatgatggaaatgtgacttctattcagactccgtagaacgggccattccaccgtctccagagacaattccaggcacacgctgtactctgacaaatgaacagcctagagagcgtagaggacgacggctgtgtacttacgtgtacgacgtaaagtatttaacgtagtaggaggtagacggttacgggggtcgtttacgg

SEQ ID NO: 409971 - DNA, 567 bp, Homo sapiens
  misc_feature: GZ8MTXP02IDJ7Z.11.71.G05.1.454.CMB.2.raw
  modified_base (295)..(295): a, c, t, g, unknown or other
  modified_base (359)..(359): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccagccgtgggagtccctgagactctcctgtacagcctctggccttcacccttcattacctatggcatgcacgtgggtcccnccagacctccgaggcgagggggctggaggtgggtggctagtttattcatatgataggaaatgtnactttctattcagtactccggtagaacggggcctattcccacccgtctcccaagacgactaacttccgaggcacacgactgtatctagactaaatgaacagaccgtaggaagacgacgtaggacggacgacgggtctggtagttattacgtcgtacgacgtaaagtctttaagtagttagacgggtagtacggtacggggtctttacg

SEQ ID NO: 409972 - DNA, 515 bp, Homo sapiens
  misc_feature: GZ8MTXP02F6A8G.11.71.G05.1.454.CMB.2.raw
  modified_base (308)..(308): a, c, t, g, unknown or other
  modified_base (488)..(488): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcacgtgggtccncagactccgaggcgaggggctgggagtggtggctagttattcatatgatggaatgtgtacttctattcagtactcgtgaaggcgatcaccgtctccagagacatccaagcacacgctgtatctgacaaatgaaacagacctagagacgcgtagacggacgacggctagtagtattaacgngtagacgaaagtatttacgtaataagg

SEQ ID NO: 409973 - DNA, 519 bp, Homo sapiens
  misc_feature: GZ8MTXP02GUF3P.11.71.G05.1.454.CMB.2.raw
  modified_base (294)..(294): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctggggacggtccctgagactctcctgtacagcctctggcttcaccttcattaccctatggcatgcacgtgggtccnccagactccgaggcagggggctgggagtgggtgctagttatttcatatgataggaaatgtgacttcattcagactcgtagaagggtccattccaccgtctccagagactaataccagacacacgctgtatctgacaaatagaacacgcctagagagcagagacgacggctgtgtatactgtcgacgaatattaagagtagacggtgtacgtacgggggtactacg

SEQ ID NO: 409974 - DNA, 553 bp, Homo sapiens
  misc_feature: GZ8MTXP02ISAWU.11.71.G05.1.454.CMB.2.raw
  modified_base (248)..(248): a, c, t, g, unknown or other
  modified_base (293)..(293): a, c, t, g, unknown or other
  modified_base (461)..(461): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtggggggagcggtggtccagccgtgggagtccctgagactctcctgtacngcctctggcttcaccttcattacctatggcatgcactgggtcccnccagacctccgaggcgagggggctgggagtgggtgctagttatttcatatgataggaaatgtgtacttctattcgagtactccggtagaacgggcctattccaccgtctccagacgacaattcacgcacacgctgtatctagacaatcgaacacgcctagagagacgngaacgacgacggtctgtagtagttacgtgtacgaacgtaaagtatttaacgtaagtaggtacggtggtaaccggttacgggggtcgtttacg

SEQ ID NO: 409975 - DNA, 630 bp, Homo sapiens
  misc_feature: GZ8MTXP02G0YM1.11.71.G05.1.454.CMB.2.raw
  modified_base (260)..(260): a, c, t, g, unknown or other
  modified_base (301)..(301): a, c, t, g, unknown or other
tcagcgagagataccacgaccggtgctcgatttagtgtcgtcgcaagagagaggggggagaggagcccagcactagaagtcggcggtgtttccattcggtgatcagcactgaacacagaggactcaccatggagtttgggctgagcgtgggttttcctcgttgctcttttaagaggtgtccagtgtcaggtgcaacgtggaggagtcgtgggggagcgtggtccagcctgggagtccctgagactctcctgtacagcctntggcttcaccttcattacctatggcatgcacgtcgggtccnccagacctccgaggccgaggggctgggaggtggggtgctagtttattcgatatgataggaaaatgtagacttcgtattcagtaccttccggtagaaacgggtcccgtaattccgacccggtcctacgaacgtaagaactaacttcccgaacggccaaaccgacgtacctaggttaactccgtagaacctaaaagttacgaaaccgagtacccgtagaacgagtaccgtaggaacggaccgaacgggtctacggttacgttaacgtttacgtagttacgaacgtaaaagtacgtttacgtagtaagtaggtacggaacggtttacggggg

SEQ ID NO: 409976 - DNA, 591 bp, Homo sapiens
  misc_feature: GZ8MTXP02JDWT4.11.71.G05.1.454.CMB.2.raw
  modified_base (293)..(293): a, c, t, g, unknown or other
  modified_base (316)..(316): a, c, t, g, unknown or other
  modified_base (335)..(335): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtgggttttccgtcgttagctcttttaagaggtgtccagtgtcaggtgcaactggaggagtctgggggagcgtggtccagcctgggaggtccctgagactctcctgtacagcctctggcttcaccttcattacctatggcatgcactggggtcccncagactcgaggcgaggggctggnggtgggtgctagtttattnatatgagtaggaaatgtgtacttctattcagtactccggtaggaacgggtcgtacttcctaccgtctaccgagacgactaactccgacgacaacgacgtatacgtatctagaactaaagtacgaacacgaccgtagagagacgtaggaacggacgacggtcgttaggttagttaacgttacgtaggtacgtaacgtaaagttagtttaacgtaagtaaggtacggttacggtacgggttacgggggtacgtttacg

SEQ ID NO: 409977 - DNA, 549 bp, Homo sapiens
  misc_feature: GZ8MTXP02IETI0.11.71.G05.1.454.CMB.2.raw
  modified_base (290)..(290): a, c, t, g, unknown or other
  modified_base (393)..(393): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggaggtccctgagactctcctgtacagcctctggcttcaccttcattaccatggcatgcacgtcgggtccnccagacctccgaggcgagggggctgggaggtgggtggctagttattcatatgataggaaaatgtgacttctattcagtactccgtagaacggcattccactcncagagacaatcagcacacgctgtatctagactaaatgaaacagcctagaagacgcgtaggacggacgaacggtctaggttagttaacttacgtgtacgacgtaaaagtactttaacgtagtaacggtaggtacggacggtacgggggtctttacgg

SEQ ID NO: 409978 - DNA, 549 bp, Homo sapiens
  misc_feature: GZ8MTXP02FP8UG.11.71.G05.1.454.CMB.2.raw
  modified_base (292)..(292): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggacggtccctgagactctcctgtacagcctctggcttcaccttcattacctatggcatgcacgtgggtccnccagactccgaggcgagggggctggagtggggtgctagtttattcatatgataggaaatgtgtacttctattcagactccggtagaacggggccattccaccgtctaccgagagacaattccagcacacgctgtatctagactaaagtagaaacagacctagagagcgtaggacggacacggtctgtagttacttacgtgtacgtacgtaagttattaagtaagtaggacggtacgtacggtacggggtacgtttcg

SEQ ID NO: 409979 - DNA, 644 bp, Homo sapiens
  misc_feature: GZ8MTXP02FVTOJ.11.71.G05.1.454.CMB.2.raw
  modified_base (267)..(267): a, c, t, g, unknown or other
  modified_base (272)..(272): a, c, t, g, unknown or other
  modified_base (316)..(316): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtgggaggagtcgtgggggaggcgtggtccagccgtgggacgtccctgagctctcctgtacngcctntcgtcttcaccttcacttacctatggcatcgcacgtcggtcccncagacctccgaggcgaggggctgggaggtggggtgcttagtttattcagttagtagtagtaggtaactgtcgtacttctattacgacgtaccgtacggtaggaacggtccgtacttccgtaaccgtctaccgaagtacgtaactaacttccgaacggaccaacgtacggtacttacgttaactacgtaacgaacttaaacgtacgaaaaccgtcgaccgtaggaacggtacgtacgtacgggaacggaccgtaacggtcgttacggtacgttaagttaacgtaggtacgtaaacgtaaagttacgtttaacgtacggtttaaacgggg

SEQ ID NO: 409980 - DNA, 519 bp, Homo sapiens
  misc_feature: GZ8MTXP02HVY53.11.71.G05.1.454.CMB.2.raw
  modified_base (299)..(299): a, c, t, g, unknown or other
  modified_base (357)..(357): a, c, t, g, unknown or other
  modified_base (400)..(400): a, c, t, g, unknown or other
  modified_base (429)..(429): a, c, t, g, unknown or other
  modified_base (432)..(432): a, c, t, g, unknown or other
  modified_base (434)..(434): a, c, t, g, unknown or other
  modified_base (437)..(437): a, c, t, g, unknown or other
  modified_base (439)..(439): a, c, t, g, unknown or other
  modified_base (450)..(450): a, c, t, g, unknown or other
tcagcgagagataccacgaccggtgctcgatttagtgtcgtcgcaagagagaggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagcctgggagtccctgagactctcctgtacagcctctggcttcaccttcattacctatggcatgcactgggtccncagactccgaggcaggggctggagtgggtggcagtttattcatatgatggaaaatgtnacttctaattcagctccgtgaaagggccatcacgtctccaganacaattccaaggcacacgctgatctaganaananaananacagagagagngagacgacgtgtgtagttattacgtacgtagagaaagtattactagtagtaggtacggtacggtacggg

SEQ ID NO: 409981 - DNA, 579 bp, Homo sapiens
  misc_feature: GZ8MTXP02G3B6B.11.71.G05.1.454.CMB.2.raw
  modified_base (291)..(291): a, c, t, g, unknown or other
  modified_base (325)..(325): a, c, t, g, unknown or other
  modified_base (362)..(362): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcacgtgggtccnccagcctccgaggcgagggggctgggagtggggngctagtttattcattatgatggaaaatcgtgtacttntattcagtactccggtagaacggggcctattccaccgtctccagagacaatccagcacacgctgtatctagacaaagtacgaaacgacgaccgtagagacgcgtaggaacggacgacgggtctaggttagttaacgttacgtaggttacgaaccgtaaaagttacgtttaacgtaagtacggtaaggtacggtaaccggttacgggggtactttcgg

SEQ ID NO: 409982 - DNA, 525 bp, Homo sapiens
  misc_feature: GZ8MTXP02J2NLA.11.71.G05.1.454.CMB.2.raw
  modified_base (323)..(323): a, c, t, g, unknown or other
  modified_base (447)..(447): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcactgggtccgccagactccgaggcgagggggctgggagtgggnggctagttattcatatgataggaaatgtgacttctattcagtactccgtgaacgggccattccaccgtctaccagagactatccgagcacacgctagtatctgacaatgaacagcctgagagcngacgacgacgtctagtagtattacgtgtagacgaaagtattaacgtagtaggaggtcgacggtacgggggctttacgg

SEQ ID NO: 409983 - DNA, 560 bp, Homo sapiens
  misc_feature: GZ8MTXP02G4K5I.11.71.G05.1.454.CMB.2.raw
  modified_base (247)..(247): a, c, t, g, unknown or other
  modified_base (293)..(293): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccaggcctgggaggtccctgagactctcctgtacngcctctggcttcaccttcattacctatggcatgcacgtgggtcccnccagacctccgaggcgagggggctgggaggtggggtggctagttattcatatgatggaaatgtgacttctattcagactccggtgaacgggccattccaccgtctaccagagacaattccagcacacgctagtatctagacaaatcgaacagacctagacgagcgtaggacggacgacggtctaggtagttacgttacgtacgttagacgtaaaagttatttaacgtaagtaggtaggtacggtaaccggtacgggggtactttcgg

SEQ ID NO: 409984 - DNA, 594 bp, Homo sapiens
  misc_feature: GZ8MTXP02HA27G.11.71.G05.1.454.CMB.2.raw
  modified_base (257)..(257): a, c, t, g, unknown or other
  modified_base (262)..(262): a, c, t, g, unknown or other
  modified_base (306)..(306): a, c, t, g, unknown or other
  modified_base (340)..(340): a, c, t, g, unknown or other
  modified_base (493)..(493): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttggctgagctgggttttcctcgttgcttcttttaagaggtgtccagtgtcaggtgcaacgtggaggagtcgtgggggagcgtggtccagccgtgggacgtccctgagactctcctgtacngcctntggcttccaccttcattacctatggcatcgcacgtcgggtcccnccagacctccgaggcgaggggctgggacgtgggngctagttattcatatgataggaaatgtagtacttctattcgagtaccgtccgtaggacgggccgtattccgacccgttcaccgagacgaactaacgttccgaacggtaccaccgtaccgtcgtagttaactcgtagaacctaaagtgaaaccncgactagacgacgacgtagacgacgtcgcgtagtacgttacttacgtacgtacgtaacgtaagttactttacgtagtacggtacggtacggtacgggtcgg

SEQ ID NO: 409985 - DNA, 514 bp, Homo sapiens
  misc_feature: GZ8MTXP02GK1PU.11.71.G05.1.454.CMB.2.raw
  modified_base (251)..(251): a, c, t, g, unknown or other
  modified_base (290)..(290): a, c, t, g, unknown or other
  modified_base (445)..(445): a, c, t, g, unknown or other
  modified_base (459)..(459): a, c, t, g, unknown or other
  modified_base (482)..(482): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctntggcttcaccttcattacctatggcatgcactgggtccnccagactccaggcagggggctgggaggtgggtggcagtttatttcatatgatggaaatgtgacttctattcagactccgtagaagggccgattcaccgtctccagagacaattccaggcacacgactgatctgacaaatgaacagcctgagagcngagacgacggctgngtattacgtgtgacgaagtattntagtaagacggtagacgtacgggggtctttcg

SEQ ID NO: 409986 - DNA, 619 bp, Homo sapiens
  misc_feature: GZ8MTXP02FZGNN.11.71.G05.1.454.CMB.2.raw
  modified_base (252)..(252): a, c, t, g, unknown or other
  modified_base (293)..(293): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctggagactctcctgtacagcctntggcttcaccttcattacctatggcatgcacgtgggtcccncagacctccgaggcgagggggctgggaggtgggtggctaggtttatttcaattagtgaagttagggaaaattaggtgtaactttcgtaatttcgacgtacgttccggtagaacggggccgtaattcccaccgtcctaccgaagaacgaactaacttccaggaccacgacgctagtatcagactaaagtgaaacagacctgaagacgtacgtaggaacggacgacggtcgtagttagttaacgttacgtaggtagtaacgtaaaagttagtttaacgtaagtaacggtaagggttacggaacggggttaccgggggtacttttacgg

SEQ ID NO: 409987 - DNA, 595 bp, Homo sapiens
  misc_feature: GZ8MTXP02F16MD.11.71.G05.1.454.CMB.2.raw
  modified_base (261)..(261): a, c, t, g, unknown or other
  modified_base (302)..(302): a, c, t, g, unknown or other
  modified_base (480)..(480): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggaggtccctgagactctcctgtacagcctntggcttcaccttcattacctatggcatgcacgtgggtcccnccagacctccgaggcgaggggctgggagtggggtggctagttattcatagtgataggaaattgtgactttctattcagtacctccggtagaacgggtccctattccgacccgttctaccgaagaacgactaacttccgaggaccacgacgtcttagtactctgactaaaagtgaaacngacctagaagagacgtaggaacggaccgacgggtcttacggttagttaacttacgtacggtagaacgtaaaagttactttacgaagtaacggtaggtacggtacgggtaccgggg

SEQ ID NO: 409988 - DNA, 510 bp, Homo sapiens
  misc_feature: GZ8MTXP02JGZ27.11.71.G05.1.454.CMB.2.raw
  modified_base (181)..(181): a, c, t, g, unknown or other
  modified_base (305)..(305): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcaactggaggagtcgtgggggagcgtggtccagcctgggagtccctgagactctcctgtacagcctctggcttcaccttcattaccatggcatgcactgggtcccnccagactccagggcagggggctgggagtggggtgcagttattcatatgattggaatgtgacttctattcagtctccgtagaacggccattcaccgtctccagagacattccaggcacacgctgtatctgacaaatgaacagcctagagacgcgtaggacggacgacggctgtgtattaacgtgtagacgaagtactttacatagg

SEQ ID NO: 409989 - DNA, 551 bp, Homo sapiens
  misc_feature: GZ8MTXP02G51HB.11.71.G05.1.454.CMB.2.raw
  modified_base (433)..(433): a, c, t, g, unknown or other
  modified_base (521)..(521): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtggggagggcgtggtccgagcgtgggaggtccgtcgagactctcctgtacagcctctgcttcaccttcattacctatggcatgcactggtccgccagactccaggcgaggggcgtggaggtggtgggcaggttatttcatatgataggtaaatagtgtacttctattcagactccgtaggaagggccgaattcgacccgtctcccagacgactaaacttacacggacacacgcgtntatcttgaccgtaaatagaacagacccgtagagagacgtgaaggacgacggacgtgtagtacttactcgtgaacgaagtattaacgtntaaggaggacgtacggtacgggggctttag

SEQ ID NO: 409990 - DNA, 552 bp, Homo sapiens
  misc_feature: GZ8MTXP02HJUDG.11.71.G05.1.454.CMB.2.raw
  modified_base (262)..(262): a, c, t, g, unknown or other
  modified_base (309)..(309): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggagtccctgagctctcctgtacngcctctggcttcaccttcattacctatggcatgccacgtcgggcccnccagactccgaggcgagggggctgggagtggggtgcagtttattcattatgataggaattgtgtacttctattcagtactcgtagaacggctatcaccgtctccagagacaatccagcacacgctgtatctagacaaagtgaaacagaccgtagaggagacgtaggacggaccgacggtacgttggtacgttaagttcgtaggtacgtaaacggtaaaagtttactttacgtaagttaaaggg

SEQ ID NO: 409991 - DNA, 551 bp, Homo sapiens
  misc_feature: GZ8MTXP02HOBE2.11.71.G05.1.454.CMB.2.raw
  modified_base (295)..(295): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggagtccctgagactctcctgtacagcctctggccttcaccttcattaccctatggcatgcacgtgggtcccnccagacctccgaggcgaggggctgggagtggggtgctagtttattcatagtgaagtggaaatgtgtactttctattcagtactccgtagaacgggtccattccaccgtctaccagtacgactaattccacgacacacgctagtatctagactaaatacaacacgcctagagagctagagagtacgtctgttagtattacgtagtagacgtaagtattaactaagtaggaggtagtacggtacggggtaccgtttcg

SEQ ID NO: 409992 - DNA, 555 bp, Homo sapiens
  misc_feature: GZ8MTXP02I2I5D.11.71.G05.1.454.CMB.2.raw
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtggggaggtccctgagctctcctgtacagcctctggcttcaccttcattacctatggcatgcacgtggtccgccagacctccgaggcgagggggctgggagtggggtgcgtagtttattcattatgagttaggaatagtagtacttctattcagtactaccgtagaacggccgattcacccgtctaccagagacatcacgacacacgctagtatctgacaaatcgaacacgaccgtagaacgacgacgtaggacggaacacggtcgtaggtacgttagtaacgtggtagacggtaaaagtactttacgtaagttaacgg

SEQ ID NO: 409993 - DNA, 623 bp, Homo sapiens
  misc_feature: GZ8MTXP02GHSHO.11.71.G05.1.454.CMB.2.raw
  modified_base (238)..(238): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggtttcgcgtaggctctttaagaggtgtcagtgtcaggtgcaatggaggagtctgggggagcgtggtccagcctgggagtcctgagactctcctgtacncgctctgtctctacttctacttactatgcatgcacgtcggtccgccgacgactccgacggcggaggggcggtggtaggtgggtgggtcgtagtttagtttctatagtagtagtagtaaagtagtagtacttacttacttctacgtacgtacgtaggtacgggtaccgtacgttaccgtaccgtaccgtaccgacgaacgaactaactaccgacgacacgacgtacgtagtacgtacgtacgtaactaaagtacgaacgacgtacgtagacgagacgtacggacggacgtacggtacgtagttagttacgttacgttaggtacgtaacgtaaagttaagttaagttaagtaggtacggtacggtacggtacggggttacggttacg

SEQ ID NO: 409994 - DNA, 546 bp, Homo sapiens
  misc_feature: GZ8MTXP02IPADI.11.71.G05.1.454.CMB.2.raw
  modified_base (244)..(244): a, c, t, g, unknown or other
  modified_base (249)..(249): a, c, t, g, unknown or other
  modified_base (399)..(399): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacngcctntggcttcaccttcattacctatggcatgcacgtgggtcccgccagacctccgaggcaggggggctgggaggtggggtggctagttattcatatgataggaaatgtgtactttctattcagtactccgtagaacgggctattccaccgtcnccagagacaattccaggcacacgctgtatctgacaaatagaacagccgtagagacgctagacggacacggtctagtgtacttacgtgtacgacgtaaagtatttaacgtaagtacggtaggtagtaccggtacgggggtctttacgg

SEQ ID NO: 409995 - DNA, 558 bp, Homo sapiens
  misc_feature: GZ8MTXP02IXR3Z.11.71.G05.1.454.CMB.2.raw
  modified_base (267)..(267): a, c, t, g, unknown or other
  modified_base (308)..(308): a, c, t, g, unknown or other
  modified_base (469)..(469): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagcctgggagtccctgagactctcctgtacagcctntggccttcaccttcattacctatggcatgcacgtgggtccnccagactccgaggccgagggggctgggagtggggtggctagttattcgatatgatggaatcgtgactttctattcagactccgtgaaggccaattccaacccgtctccagtacgacaattccaaggcaacgacgtctagtatctagtacaaaatgaaaacncgaccgtgaacgagcgtaggacggacgacggcttcggtagttacgttaacgtggtacggtaacgaaaagttatttacgtaagtaaaggg

SEQ ID NO: 409996 - DNA, 577 bp, Homo sapiens
  misc_feature: GZ8MTXP02JK6N6.11.71.G05.1.454.CMB.2.raw
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggaggtccctgagactctcctgtacagcctctggccttcaccttcattaccatggcatgcacgtgggtcccnccagactccgaggcgagggggctgggaggtggggtgctagtttattcatatgagtaggaaatagtgtactttctattccgaagtcttccggtagaacggggcctattccgacccgtctacccagagacaattccagcacacgtctgtatctgacaaatacgaacagcctagagagcgtggaacggacgacggtctaggttacgttaagttacgttacggtacgtacgtaaagtatttaacgtaagttaacggtagggtcggaaacggttcgggggtacgtttacgg

SEQ ID NO: 409997 - DNA, 599 bp, Homo sapiens
  misc_feature: GZ8MTXP02IKARS.11.71.G05.1.454.CMB.2.raw
  modified_base (247)..(247): a, c, t, g, unknown or other
  modified_base (293)..(293): a, c, t, g, unknown or other
  modified_base (359)..(359): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggacggtccctgagactctcctgtacngcctctggcttcaccttcattacctatggcatgcacgtgggtcccnccagcctccgaggcgaggggctgggagtgggtggctagttattcatatgataggaaatgtgacttntattcagtactccggtagacgggcattccaccgtctccagagacaattcacgacacacgctgtatctagactaaatgaaacacgccgtagaagagacgtaggaaacgggacgaaccggtcgtaggttaggttaacttttaacgtacggttacgaaaacggttaaaagttaacttttaacgttaaacgttaacgggtaacgggttacggtaaccgggtttaaccgggggtcgttttaacgg

SEQ ID NO: 409998 - DNA, 563 bp, Homo sapiens
  misc_feature: GZ8MTXP02FOW7F.11.71.G05.1.454.CMB.2.raw
  modified_base (259)..(259): a, c, t, g, unknown or other
  modified_base (301)..(301): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacagcctntggcttcaccttcattaccctatggcatgcacgtgggtcccnccagacctccgaggcgaggggctggagtgggtggctagttattcatagtgataggaaatgtgactttctattcagacctccgtagaacgggccgtattccaccgtctccagagacaattccaggcacacgctgtatctagacaaaatgaaaccagcctagacgagacgtaggacggacgacggtcttacggtagttaacttacgtacggtagaacgaaaagttatttacgtaagtaggtaggtacgtacggttaaccggggg

SEQ ID NO: 409999 - DNA, 598 bp, Homo sapiens
  misc_feature: GZ8MTXP02HX2ZM.11.71.G05.1.454.CMB.2.raw
  modified_base (302)..(302): a, c, t, g, unknown or other
  modified_base (378)..(378): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttggctgagcttgggttttcctcgttgcttcttttaagaggtgtccagtgtcaggtgcaactggaggagtcgtgggggagcgtggtccagccgtgggacgtccctggagactctcctgtacagcctctggcttcaccttcattacctatggcatgcacgtggtccnccagacctccgaggccgaggggctgggagttgggtgctagtttattcattagagtataggaaaattgtagtacttntattacacgtacctccggtaggaaacggccgtattccgaccgtctccaagaagactaacttccaggccacacgacttgtactcgtagactaaatacgaaacacgaccgtagaacgagacgtacggaaaggtacgaacgggtcttagtacgttaattacgtacgtagtaaccgtaaaagttactttacgtaaagtagacgggttagtaaccgggtacgggg

SEQ ID NO: 410000 - DNA, 606 bp, Homo sapiens
  misc_feature: GZ8MTXP02I9MLG.11.71.G05.1.454.CMB.2.raw
  modified_base (250)..(250): a, c, t, g, unknown or other
  modified_base (294)..(294): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggaggcgtggtccagccgtggggacgtccctgagactctcctgtacngcctctggcttcaccttcattacctatggcatgcactgggtccnccagactccgaggcgagggggctgggagtggggtggctagttattcatagtgataggaaatgtagtacttacgtattcgagtactccggtagaacgggcctaattcccaccgtcctaccagacgacaacttccgacggacacacgctagtactctagactaaagtacgaaacgagtaccgtaggacggacgacgtaggaacggacgaccgggtacgttgttacgttaacgtttaccgtagtacgaaccgtaaagttactttaacgtaagttaacggtagggtacgtaacggtacgggggtacttttaccggg

SEQ ID NO: 410001 - DNA, 572 bp, Homo sapiens
  misc_feature: GZ8MTXP02F4NK5.11.71.G05.1.454.CMB.2.raw
  modified_base (292)..(292): a, c, t, g, unknown or other
  modified_base (353)..(353): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcacgtgggtcccncagacctccgaggcgaggggctgggagtgggtgctagtttattcatatgataggaaatgtntacttctaattcgagtaccttccggtaggaaacggggtcccgtaatttcccacccgtcctacccgaagaacgaacaaacttaccaggacacacgctgtactctagactaaatagaaacagacccgtagaagagctaggaacggacacggtactgtagtattacgtgtacgacgtaaagtattaacgtaagtagaggtagtacggtacggggcgtttacg

SEQ ID NO: 410002 - DNA, 537 bp, Homo sapiens
  misc_feature: GZ8MTXP02GV464.11.71.G05.1.454.CMB.2.raw
  modified_base (309)..(309): a, c, t, g, unknown or other
  modified_base (340)..(340): a, c, t, g, unknown or other
  modified_base (413)..(413): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggagtccctgagactctcctgtacagcctctggcttcaccttcattacctatggcatgcacgtgggtccnccagactccgaggcgaggggctggagtgggngcagtttattcatatgagtaggaatgtgacttctattcagactccgtagaacggcgattcaccgtcaccaganacattccaggcacacgtctgtactcgtacgacaaatgaaacacgacctagaagacgcgtaggacggacgacggcttagtagttagttaacgtgtacgacgtaaagttatttacgtaagtaaggg

SEQ ID NO: 410003 - DNA, 557 bp, Homo sapiens
  misc_feature: GZ8MTXP02HRDWH.11.71.G05.1.454.CMB.2.raw
  modified_base (264)..(264): a, c, t, g, unknown or other
  modified_base (309)..(309): a, c, t, g, unknown or other
  modified_base (372)..(372): a, c, t, g, unknown or other
  modified_base (378)..(378): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggagcgtggtccagccgtgggaggtccctgagctctcctgtacngcctctggccttcaccttcacttacctatggcatgcacgtggccncagctccgaggcgaggggctgggaggtggggtgctagtttatttcgatatgagtaggaatgtntacttntattcagtactcgtagaacggccgtatcaccgtctaccgagacgacactcaggcacacgtctagtactctagactaaatagaaacgacgcgtagaacgacgacgtaggaacggaccgaacggtcgttagtacgttattaacgtgtacggtacgtaaaagtactttacgtaagttaaggg

SEQ ID NO: 410004 - DNA, 530 bp, Homo sapiens
  misc_feature: GZ8MTXP02IYN89.11.71.G05.1.454.CMB.2.raw
  modified_base (181)..(181): a, c, t, g, unknown or other
  modified_base (265)..(265): a, c, t, g, unknown or other
  modified_base (304)..(304): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcaactggaggagtcgtgggggagcgtggtccagccgtgggagtcctgagctctcctgtacagcctnggcttcaccttcattacctatggcatgcacgtgggtccncagctccgaggcgaggggctgggagtgggtggctagttattcgatatagatagatgtgtacttctattcagactccgtagaaggccgattcgaccgtctccagacaacattccaggaccacacgtctagtactcgtgacaaatgaaacagcctagagagcaggacggacgacggtctagttaggattaacgtggtacgtacggtaaagtactttactaagtaaggg

SEQ ID NO: 410005 - DNA, 552 bp, Homo sapiens
  misc_feature: GZ8MTXP02F2TLD.11.71.G05.1.454.CMB.2.raw
  modified_base (306)..(306): a, c, t, g, unknown or other
  modified_base (472)..(472): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcaacgtggaggagtcgtgggggagcgtggtccagcctgggagtcctgagactctcctgtacagcctctggcttcaccttcattacctatggcatgcacgtgggccncagactccgaggcgaggggctggacgtggggtgctagtttattcagtatgataggaatgtgtacttctattcagtactccgagaagggcctaattccaccgtctaccgagaacgacaaacttccgaaggccaacgacgtctagtaactctagactaaatgaaaccngacgtagagacgacgaggacggacacggtcttagtagttactaagtagtacgtaacgtaaagttactttacgtaagtagg

SEQ ID NO: 410006 - DNA, 542 bp, Homo sapiens
  misc_feature: GZ8MTXP02JV0VY.11.71.G05.1.454.CMB.2.raw
  modified_base (309)..(309): a, c, t, g, unknown or other
  modified_base (437)..(437): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggaggtccctgagactctcctgtacagcctctggcttcaccttcattacctatggcatgcacgtgggtccnccagactccgaggcagggggctgggagtggggtgctagtttattcatatgataggatgtgtacttctattcagtactccgtgaacgggccgtattccaccgtctccgagacgacacttccaggccacncgctgtatctgacaaatcgaaacagcctagagtacgcgtaggacggacgacggtctagtagttacttaacgtgtacggacgtaaagtacttttacgaagtaaggg

SEQ ID NO: 410007 - DNA, 613 bp, Homo sapiens
  misc_feature: GZ8MTXP02GRXNT.11.71.G05.1.454.CMB.2.raw
  modified_base (265)..(265): a, c, t, g, unknown or other
  modified_base (295)..(295): a, c, t, g, unknown or other
  modified_base (301)..(301): a, c, t, g, unknown or other
  modified_base (327)..(327): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtgggttttcctcgttgctctttaagaggtgtccagtgtcaggtgcaactggaggagtcgtgggggaggcgtggtccagcctggggagtccctgagactctcctgtacagcctctggcttcacccttnattaccctatggcatgcactgggtaccccncagacncgaggcggaggggctgggaggtgggngtacgtagtttattcgatgtagagtaggaatcgtgtacttattatcacgtactacggaggaacgggtcctatcccgtaccgtctaccgagacgactacgtcgacgacacgacgtctagtactacgtacgaactaaagtacgaacgacgaccgtaggaacggtacgtacgtaggacgacgtacgggtacgttggtagtttaacgttacggtacggtacggtaacgtaacgttagtttaacgtaagtacggtacggtacggtaccggggtacgggggtacgtttacgg

SEQ ID NO: 410008 - DNA, 588 bp, Homo sapiens
  misc_feature: GZ8MTXP02H8YUZ.11.71.G05.1.454.CMB.2.raw
  modified_base (253)..(253): a, c, t, g, unknown or other
  modified_base (292)..(292): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagcctggggagtccctgagactctcctgtacagcctntggcttcaccttcattaccatggcatgcacgtgggtccnccagacctccgaggcgagggggctgggaggtggggtggctagttattcatatgataggaaatgtgtacttctattcagtactccggtagaacgggccgtaattccacccgtcaccgagacgaacaagttacccaggaccaacacgtctagtactccgttagaactaaaatcgaaacacgcctagagagctaggaggaccgacgggtactggttagttaacttacgtggtacgtacggtaaagttacttttaacgaagtaacggaggttacggaccggtacgggggtacctttccgg

SEQ ID NO: 410009 - DNA, 522 bp, Homo sapiens
  misc_feature: GZ8MTXP02HD28X.11.71.G05.1.454.CMB.2.raw
  modified_base (304)..(304): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggagcgtggtccagcctgggagtccctgagactctcctgtacagcctctggcttcaccttcattacctatggcatgcactgggtccnccagactccgaggcgagggggctgggagtgggtggcagttattcatatgatggaatgtgacttctattcagactccgtagaacggcgtattcaccgtctccagagacattccaggcacacgctgtatctagacaaatgaacagtcctagaagacgctaggacggacacggctgttagtacttaacgtggtacgacgtaaaagtctttacgtagtaagg

SEQ ID NO: 410010 - DNA, 545 bp, Homo sapiens
  misc_feature: GZ8MTXP02HOWYE.11.71.G05.1.454.CMB.2.raw
  modified_base (312)..(312): a, c, t, g, unknown or other
  modified_base (343)..(343): a, c, t, g, unknown or other
  modified_base (378)..(378): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggaggcgtggtccagccgtgggaggtccctgagactctcctgtacagcctctggcttcaccttcattacctatggcatgcacgtgggtcccncagactccgaggcgaggggctggagtggggngcagttatttcatatgaagtgaattgtgaactttntattcaagtacctaccgtagaaaggccgtaattcccgaccgtctacccagagaacctattccgaaggcaacacgtctcgtatctagacaaagtgaacacgcctagaagcgacgtagacgacgacgctcgtagtacttaagtgtagacgaaaagtctttactagtagg

SEQ ID NO: 410011 - DNA, 606 bp, Homo sapiens
  misc_feature: GZ8MTXP02HH0Z7.11.71.G05.1.454.CMB.2.raw
  modified_base (252)..(252): a, c, t, g, unknown or other
  modified_base (295)..(295): a, c, t, g, unknown or other
  modified_base (473)..(473): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggttttcctcgttgctcttttaagaggtgtccagtgtcaggtgcaacgtggaggagtcgtgggggaggcgtggtccagcctgggaggtccctgagactctcctgtacagcctntggccttcaccttcattaccctatggcatgctacgtgggtccnccagctccgaggcgaggggctgggagtgggtgctagtttattcatatgagtaggaaaattcggtagtacttacgtattccgaagtacctccggtaggaacggggtcctaatttcccaacccgtctacccgaagacgtaactaaacgttcccgaaggccaacgacgtctagtatcgtanaactaatacgaacacgacgtagacgacgacgaggacggacgacggtacgtaggttagttaacttacgtaggtacgtaacgtaagttattaagtaagtacggtacggtacggtaccggttacggggtctttacg

SEQ ID NO: 410012 - DNA, 609 bp, Homo sapiens
  misc_feature: GZ8MTXP02H5S6A.11.71.G05.1.454.CMB.2.raw
  modified_base (244)..(244): a, c, t, g, unknown or other
  modified_base (290)..(290): a, c, t, g, unknown or other
  modified_base (324)..(324): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacngcctctggcttcaccttcattacctatggcatgcacgtcgggtccnccagacctccgaggcgagggggctgggagtgggngctagttattcatatgagtaggaaaattgtgtactttctatttcgaagtacctcccggtagaacggggtccctaattcccgacccgttcaccgagaacgaactaacttccgacggcacgacgtctgtactctagactaaagtacgaacacgtaccgtaggaacgtagacgtaggacggaaccgacgggtcgttaggttagttaattacggtgtacggaacgtaaaagttatttaacgtaagtaaggtacgggtacggtaaccggttacgggggtaccgtttacgg

SEQ ID NO: 410013 - DNA, 561 bp, Homo sapiens
  misc_feature: GZ8MTXP02F7KT3.11.71.G05.1.454.CMB.2.raw
  modified_base (261)..(261): a, c, t, g, unknown or other
  modified_base (300)..(300): a, c, t, g, unknown or other
  modified_base (342)..(342): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggagtccctgagactctcctgtacagcctntggcttcaccttcattacctatggcatgcactgggtccnccagactccgaggcagggggctgggagtggggtggctagttnttcatatgatggaaatgtgacttctattcagtactccggtagaacggggcctattcacccgtctaccgagaacgacaattccaggcacgacgctgtatcgtgacaaagtgaacagcctgagagcgtaggaacggacgacgggtctaggtgttaacttacgtgtaggaacgtaaaagtactttacgtaagtaaggaggttacggaacggtttaccggggg

SEQ ID NO: 410014 - DNA, 563 bp, Homo sapiens
  misc_feature: GZ8MTXP02HYY12.11.71.G05.1.454.CMB.2.raw
  modified_base (302)..(302): a, c, t, g, unknown or other
  modified_base (365)..(365): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacagcctctggcttcaccttcattacctatggcatcgctacgtgggtcccnccagactccgaggcgaggggctgggagtgggtgctagtttattcatagtgataggaaaatgtnactttcgtattcagtaccttccggtagaaacgggccgtaattccgaccgtctacccgagacgactaacttccaggcacacgctgtatctgacaatagaacagcctagagagcgtagaggaccgacggtcttgtagttaacttacgtagtcgaacgtaaagttactttactaagtagtaggtacgtaacggtacggggg

SEQ ID NO: 410015 - DNA, 578 bp, Homo sapiens
  misc_feature: GZ8MTXP02G437S.11.71.G05.1.454.CMB.2.raw
  modified_base (254)..(254): a, c, t, g, unknown or other
  modified_base (272)..(272): a, c, t, g, unknown or other
  modified_base (301)..(301): a, c, t, g, unknown or other
  modified_base (503)..(503): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcgtggttttcctcgttgctctttaagaggtgtccagtgtcaggtgcaactggaggagtcgtgggggagcgtggtccagccgtgggacgtcctgagactctcctgtacngcctctggcttcaccttnacttacctatggcatcgcacgtgggcccnccagacctccgaggccgagggggctgggaggtgggtggctagtttattcatagtgataggtaaaatgtagtactttctattcagtacctcgtagaacggcctatcaccgtctcagagacaacttccgacggcacgacgtactgtaactctagaactaactacgaaacacgaccgtaggacgagtacgaggacggacgacggnttcgtacgttattaacgtgtacggaagtaaaaggtttctttaacgtagtaggtacggtacggtacgggtacgggg

SEQ ID NO: 410016 - DNA, 586 bp, Homo sapiens
  misc_feature: GZ8MTXP02HCK8R.11.71.G05.1.454.CMB.2.raw
  modified_base (295)..(295): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggacgtccctgagactctcctgtacagcctctggcttcaccttcattacctatggcagtgcacgtgggtcccnccagacctccgaggccgagggggctggaggtgggtgctagttattcatatgataggaaattgtgtacttctattcacgtactccgtaggaacgggctattccaccgtctacccagacgacaacttcgaggacaccgacgctagtactcgtagactaaagtacgaaacgacgccgtagagacgacgtacggagacgacggtcgtaggttacggttattacgtggtacgtaacgtaaagttacgtttaagtaagtaggtaggtacggtacgggttaacgggggtcctttacgg

SEQ ID NO: 410017 - DNA, 553 bp, Homo sapiens
  misc_feature: GZ8MTXP02I6BTI.11.71.G05.1.454.CMB.2.raw
  modified_base (291)..(291): a, c, t, g, unknown or other
  modified_base (316)..(316): a, c, t, g, unknown or other
  modified_base (354)..(354): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggtttccgtcgttaggctctttaagaggtgtccagtgtcaggtgcaactggaggagtctgggggagcgtggtccagcctgggaggtccctgagactctcctgtacagcctctggcttcaccttcattacctatggcatgcactggggccccncagacctcgaggcgaggggctgggnggtgggtgctagtttattcatatgagtaggtaaatgtntacttctatcgagtacctcggagaacgggctattccaccgtctacgagacgaactactaccgagacacgacgtctagtactctagactaatagaacgacgacgtagagagcgagacggacgacggtacgtgtagtacgttagtagtacgtacgtaagtagttaagtagtagtaggtaggtacggtacgggtacggttcg

SEQ ID NO: 410018 - DNA, 589 bp, Homo sapiens
  misc_feature: GZ8MTXP02IMXL9.11.71.G05.1.454.CMB.2.raw
  modified_base (249)..(249): a, c, t, g, unknown or other
  modified_base (289)..(289): a, c, t, g, unknown or other
  modified_base (327)..(327): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctctgtacagcctntggcttcaccttcattacctatggcatgcacgtgggtccnccagactcgaggcaggggctggagtgggtggctagttnttcatatgataggaaatgtgactttctattcgagtactccggtagaacgggggcctattcaccgtctacccgagacgacaacttccacggcacacgctgtatctgactaaatcgaactacgccgtgagagacgtaggacggacgaccggtcttaggttagttaacgtttaccgtaggttacgtaaaccgtaaaagttacgttttaacgtaagttaacggtacggggttaggaaccgggtttaccgggggtacgttttaccgg

SEQ ID NO: 410019 - DNA, 504 bp, Homo sapiens
  misc_feature: GZ8MTXP02GV3EK.11.71.G05.1.454.CMB.2.raw
  modified_base (334)..(334): a, c, t, g, unknown or other
  modified_base (362)..(362): a, c, t, g, unknown or other
  modified_base (424)..(424): a, c, t, g, unknown or other
  modified_base (435)..(435): a, c, t, g, unknown or other
  modified_base (445)..(445): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtcctgagactctctgtacagcctctggcttcaccttcattacctatggcatgcacgtgggtccgccagactccaggcgaggggctggagtgggngcagttattcatatgatgatgtgacttntattcagtactcgtgaggcatcaccgtctaccagacgacaatccaagcacacgctgtactcngacaatgaacngcctgagacncgtagacggacacggctgtagtattaacgtgtacgacgtaaagtactttacgattaagg

SEQ ID NO: 410020 - DNA, 644 bp, Homo sapiens
  misc_feature: GZ8MTXP02IS7QF.11.71.G05.1.454.CMB.2.raw
  modified_base (250)..(250): a, c, t, g, unknown or other
  modified_base (380)..(380): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccaggccgtggggacgtcctgacgactctcctgtacngcctctgcttcaccttcattacctagtggcagtcgctacgtcgggtccccaccagacctccgagggcgagggggctggggaggtggggtgtactagtttattcatagtgaagtaggaaatgtgtactttntattcgacgtactccggtagaacggggtcctaacttccacccgtctaccgaagacaactaacgtcgacggaccacgtacgtctagtaactcgtacgaactaaagtacgaaacacgaccgtaggaacgtacggacgtacggaacggaccgaacggtcgttaggttacgttaagttaccgtaggtaacgtaaacgttaaagttacgtttaacgtaaggttaacggtacgggttacggtaacgggttaccgggggttcgtttaccgg

SEQ ID NO: 410021 - DNA, 630 bp, Homo sapiens
  misc_feature: GZ8MTXP02JK528.11.71.G05.1.454.CMB.2.raw
  modified_base (261)..(261): a, c, t, g, unknown or other
  modified_base (311)..(311): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagtcttgggttttcctcgttgcttcttttaagaggtgtccagtgtcaggtgcaacgtggaggagtcgtgggggagcgtggtccagccgtgggacgtccctgagactctcctgtacncgcctcgtggccttcaccttcattaccctatggcatgcacgtgggtcccncagacctccgaggcgaggggctggaggtgggtgctagtttattcatagtgagtaggaaaactgtagtactttcgtattcgacgtacctccggtaggaacgggtcccgtacttccacccgtctaccgagaacgtactaacttaccgacggccacgacgtctgttactactagaacaaagtacgaaacgacgtccgtaagaagacgtacgtacggacggtaacgaaccgggtgttacggtacgttaagtttacgtaggtacgtaacgtaaagttacgtttaactaaggtaggtagggttacggtacgggtttaaccggggg

SEQ ID NO: 410022 - DNA, 567 bp, Homo sapiens
  misc_feature: GZ8MTXP02HFWCC.11.71.G05.1.454.CMB.2.raw
  modified_base (300)..(300): a, c, t, g, unknown or other
  modified_base (533)..(533): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctcctgtacagcctctggcttcaccttcattaccatggcatgcacgtcgggtccnccagacctccgaggcgagggggctgggagtggggtgctagtttattcgatatgataggaaatgtgacttctattcagtacctccgtagaagggcccgattccacccgtctaccgagacgactaacgtccaaggacacgacgtctagtactctagacctaaatagaaacagacctgaaggagacgtggaacggacacggtcgtagtgtaacttcgtacgtgtaacgtaaagttntttactagtaggtaggtacgaacggttacggggg

SEQ ID NO: 410023 - DNA, 539 bp, Homo sapiens
  misc_feature: GZ8MTXP02FZRIA.11.71.G05.1.454.CMB.2.raw
  modified_base (305)..(305): a, c, t, g, unknown or other
  modified_base (437)..(437): a, c, t, g, unknown or other
  modified_base (458)..(458): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggagcgtggtccagcctgggagtccctgagactctcctgtacagcctctggcttcaccttcattacctatggcatgcacgtgggtccnccagactccgaggcagggggctgggacgtggggtggcaggtttatttcattatgatgggaatgtgtacttctattcagtactccgtagaaggccgattccaccgttctccagagacaactcgaggcacacgntgtatctgacaaatcgaaacncgactagagacgacgaggacggacgacgtcgtacgtagttacttaacgtgtacgacgtaaagttacgtttacgtaagtagg

SEQ ID NO: 410024 - DNA, 527 bp, Homo sapiens
  misc_feature: GZ8MTXP02GSC2K.11.71.G05.1.454.CMB.2.raw
  modified_base (262)..(262): a, c, t, g, unknown or other
  modified_base (310)..(310): a, c, t, g, unknown or other
  modified_base (344)..(344): a, c, t, g, unknown or other
  modified_base (354)..(354): a, c, t, g, unknown or other
  modified_base (358)..(358): a, c, t, g, unknown or other
  modified_base (376)..(376): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcgtggttttcctcgtgctctttaagaggtgtccagtgtcaggtgcaactgggaggagtcgtgggggagcgtggtccagccgtggggagtccctgagactctcctgtacncgcctgtggcttcaccttcattacctatggcatgcacgtcgggtcccnccagacctccgaggcgaggggctgggagtggggngctagttatnatangataggaatcgtgacttntatcacgtctcgagaacggctatccaccgtcacagacaactactccgagcacacgtctagtactcagacaatacgaacgacgacgagagacgacgagacgacgacgacgtacgtagtataacgtgtacgtacgtaagtacttacgtagtag

SEQ ID NO: 410025 - DNA, 532 bp, Homo sapiens
  misc_feature: GZ8MTXP02GJYP6.11.71.G05.1.454.CMB.2.raw
  modified_base (307)..(307): a, c, t, g, unknown or other
  modified_base (456)..(456): a, c, t, g, unknown or other
  modified_base (517)..(517): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctggggagtccctgagactctcctgtacagcctctggcttcaccttcattacctatggcatgcactgggtcccncagactccaggcagggggctgggagtggggtggctaggtttattcatatgatggaatgtgtactttctattcagtacctccgtgaaagggccattcacccgtctccagacgacattccaggcacacgtctgtatctgacaaatgaaacngacctagagacgctaggacggacgacggctcgtagtattaacgtgttacggacgtaaagtntttacgagttaaggg

SEQ ID NO: 410026 - DNA, 546 bp, Homo sapiens
  misc_feature: GZ8MTXP02GLIXA.11.71.G05.1.454.CMB.2.raw
  modified_base (293)..(293): a, c, t, g, unknown or other
  modified_base (358)..(358): a, c, t, g, unknown or other
  modified_base (364)..(364): a, c, t, g, unknown or other
  modified_base (402)..(402): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggttttcgtcgtagctctttaagaggtgtccagtgtcaggtgcaactggaggagtcgtgggggaggcgtggtccagccgtgggaggtccctgagactctcctgtacagcctctggtcttcaccttcattacctatggcatgcacgtcgggtccnccagacctccgaggcgagggggctgggaggtgggtgctagtttattcatatgataggaaatcgtntacttnattcagactcggtagaacgggctatcaccgtctcaganacatcagcacacgctgtatctagacaataagaacgacgacgtagagagacgagacgacgacgtcgtagttagttacgttacgtacgtacgtaacgtaagttattaagttagtaggtacggtaggtacggtacgggtacggttcg

SEQ ID NO: 410027 - DNA, 584 bp, Homo sapiens
  misc_feature: GZ8MTXP02HLCAT.11.71.G05.1.454.CMB.2.raw
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggaggtccctgagactctcctgtacagcctctggcttcaccttcattaccctatggcatgcactcgggtccnccagactccaggcgaggggctggaggtggggtggcagttattcatatgatggaaatagtgacttcgtattcagactccgtagaacggggccgattccacccgtctacccaagtacgactaacgttccaggtccaacacgctgttatccttagacctaaagtcgaacgaacgccctaggaagaagtccgtaggacggaccgaacggtcgtaggttagttaacgtttacgtagtacgacgtaaaagtactttaacgtagtaaggtacggtagtaccggtacgggggtctttacgg

SEQ ID NO: 410028 - DNA, 641 bp, Homo sapiens
  misc_feature: GZ8MTXP02GRCP8.11.71.G05.1.454.CMB.2.raw
  modified_base (294)..(294): a, c, t, g, unknown or other
  modified_base (327)..(327): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggaggcgtggtccagccgtgggaggtccctgagactctcctgtacagcctctggcttcaccttcattacctatggcatgcacgtgggtccnccagacctccgaggcgaggggctggaggtgggngctagtttattcatatgagtaggaaatgtagtactttctattcagtactccgtagaacggggtcctattccaccgttctacccgagtacgaactaacgttcccgaacggaccaaccgaccgtcttacggtaacttccgttacgactaaaactaggaaacccgagacccgttaggaacgaggtaccgtagggaacgggaccgtaaccgggtccttagggttgtttaaacgttaccgtaggtacgaaaccgtaaaaggttactttaacgtaagtaacgggtaggtcggtaaccgggttacgggggtctttaaccgg

SEQ ID NO: 410029 - DNA, 527 bp, Homo sapiens
  misc_feature: GZ8MTXP02FVR9D.11.71.G05.1.454.CMB.2.raw
  modified_base (307)..(307): a, c, t, g, unknown or other
  modified_base (367)..(367): a, c, t, g, unknown or other
  modified_base (373)..(373): a, c, t, g, unknown or other
  modified_base (403)..(403): a, c, t, g, unknown or other
  modified_base (444)..(444): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacagcctctggcttcaccttcattacctatggcatgcacgtgggtcccncagcctccgaggcgagggggctgggagtggggtgctagttattcatatgataggaatgtntacttntattcagtactcgtgaacggcatcacgtcncagagacatcagcacacgctgtactctagacaaatgaaacngacctaggaacgacgcgtaggacggtacgacggtctagtgtaattaacgtggtacgaacgtaaagtactttacgtaagtaagg

SEQ ID NO: 410030 - DNA, 540 bp, Homo sapiens
  misc_feature: GZ8MTXP02FTIKM.11.71.G05.1.454.CMB.2.raw
  modified_base (259)..(259): a, c, t, g, unknown or other
  modified_base (304)..(304): a, c, t, g, unknown or other
  modified_base (344)..(344): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggagcgtggtccagcctgggagtccctgagctctcctgtacngcctctggcttcaccttcattacctatggcatgcacgtgggtccnccagactccgaggcgagggggctggagtgggtgctagttnttcatatgataggatgtgtacttctattcagtactccgtaggaacggccgtattccacccgtctacccgaagacgactaactccgaggcacacgctgtatctagacaaatgaacagcctagagacgctaggacggacacgggtcttaggtagttacttaacgtgtacgtacgaaagttactttacgtaagtaaggg

SEQ ID NO: 410031 - DNA, 576 bp, Homo sapiens
  misc_feature: GZ8MTXP02ILVA5.11.71.G05.1.454.CMB.2.raw
  modified_base (292)..(292): a, c, t, g, unknown or other
  modified_base (334)..(334): a, c, t, g, unknown or other
  modified_base (354)..(354): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggagtccctgagactctcctgtacagcctctggcttcaccttcattacctatggcatgcacgtgggcccnccagcctccgaggcgagggggctgggagtgggtgctagtttnttcatatgataggaaatgtntacttctatcagtactccgtagaacggggtcctaattccgaccgtcaccgagacgactaagttccgaggacacacgctagtatctagactaaagtacgaacacgcctagacgagtcgtaggaacgacgacggtcttggttagttaacttacgtaggtacgtaacgtaaagttactttaacgtaagtaggtacggtacgtaccggttacgggggtactttacg

SEQ ID NO: 410032 - DNA, 529 bp, Homo sapiens
  misc_feature: GZ8MTXP02GRHQC.11.71.G05.1.454.CMB.2.raw
  modified_base (263)..(263): a, c, t, g, unknown or other
  modified_base (289)..(289): a, c, t, g, unknown or other
  modified_base (467)..(467): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctcctgtacagcctctggcttcaccttnattacctatggcatgcactgggtccnccagactccgaggcagggggctgggagtgggtggctagtttattcatatgataggaaatgtgtacttctattcagactccggtagaacgggccattccaccgtctaccgagagactaatccaggcacacgctgtatctgactaaatcgaacagcctagagagctgagacacggctgtntacttacgtgtagacgtaaagtattaacgtagtagtacggtagacgtacgggggtctttacg

SEQ ID NO: 410033 - DNA, 577 bp, Homo sapiens
  misc_feature: GZ8MTXP02JVFIR.11.71.G05.1.454.CMB.2.raw
  modified_base (294)..(294): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggaggtccctgagactctcctgtacagcctctggcttcaccttcattaccctatggcatgcacgtgggtcccnccagacctccgagggcgagggggctgggaggtggggtggctagttattcatatgataggaaatgtgtacttctattcagtactccggtagaacgggccgtattccaccgtctccagacgacaatccaggcacacgctagtatctagacaaatcgaacagcctagagagctaggaacggacgacgggtcgtggttagttaacgttacgtaggttacggaacgtaaaagttagtttaacgtaagttacggaggggttacggtaacggttacgggggtactttcgg

SEQ ID NO: 410034 - DNA, 548 bp, Homo sapiens
  misc_feature: GZ8MTXP02F6K6B.11.71.G05.1.454.CMB.2.raw
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattaccctatggcatgcactgggtccnccagactccaggcgagggggctgggaggtggggtggctagtttattcatatgataggaaatagtgtacttctattcagtactccgtagaacggggcctattccaccgtctaccagacgacaacttccagacacacgctgtatctgacaaatgaaacacgcctagagagctagaggacgacggctgtagttacttacgtgtacgacgtaaagtatttaacgtaagtaggtaggtaggtacggtacgggggtctttacg

SEQ ID NO: 410035 - DNA, 584 bp, Homo sapiens
  misc_feature: GZ8MTXP02IIUQY.11.71.G05.1.454.CMB.2.raw
  modified_base (250)..(250): a, c, t, g, unknown or other
  modified_base (295)..(295): a, c, t, g, unknown or other
  modified_base (449)..(449): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtggggggaggcgtggtccaggcctggggaggtccctgagactctcctgtacngcctctggcttcaccttcattacctatggcatgcacgtgggtccncagctccgaggcgaggggctgggagtgggtgctagttattcatatgagtaggaaatgtgtacttctatcagtactccgtagaacgggcctattcccacccgtcccagacgactactccgagccacacgctagtactctagacaaagtcgaaacncgcctagacgagcgtacggaaggaccgtacggacttaggtacgttagttacgtaggtagaacggtaaaagttacgttttacgaagttacggtaagggttacggaaccggttacgggggtctttacggtttaacgg

SEQ ID NO: 410036 - DNA, 547 bp, Homo sapiens
  misc_feature: GZ8MTXP02JV2MM.11.71.G05.1.454.CMB.2.raw
  modified_base (311)..(311): a, c, t, g, unknown or other
  modified_base (345)..(345): a, c, t, g, unknown or other
  modified_base (415)..(415): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggagcgtggtccagccgtgggaggtccctgagactctcctgtacagcctctggcttcaccttcattacctatggcatgctacgtcgggtccnccagacctccgaggcgaggggctgggagtggggngctagtttattcatatgataggaatgtgactttctattcagtacctcgtggaaaggccgatccaccgtcnccagagacacttccagcacacgctgtactctgacaaatacgaacacgacctagaacgacgacgtaggaacggaccgaacggtcgtgtagttacgttaacgtgtacggacgtaaagtactttacgtaagtagg

SEQ ID NO: 410037 - DNA, 647 bp, Homo sapiens
  misc_feature: GZ8MTXP02HV7O3.11.71.G05.1.454.CMB.2.raw
  modified_base (269)..(269): a, c, t, g, unknown or other
  modified_base (543)..(543): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcgtggtttcctcgttgctctttaagaggtgtccagtgtcaggtgcaacgtgggaggagtcgtggggggaggcggtggtccaggccgtgggacggtccctggagctcctcctgtacngcctctcggcttcaccttcacttacctagtcggactagtcgaccgtacggttcggggtaccccaccgaggaccctcccggaggggccggaggggggtctaggggagggtgggggtggtacgttaaggttttatttacaagttagtaggtaagttaagggtaaattcggttagtacctttcgttaattcgaagtaccgtaccggtaggaaccgggtccgtacgttccgacccgtcctaccgaacgacgaactaacgtaccgaggaccacgacgtntacgtacgtctagaaccaaatacgaacacgcgtagacgacgcgtaggacgaccgacggtctgtagtattaacgtgtagacgtaaagtactttacgtaagtaggg

SEQ ID NO: 410038 - DNA, 581 bp, Homo sapiens
  misc_feature: GZ8MTXP02F8YRL.11.71.G05.1.454.CMB.2.raw
  modified_base (293)..(293): a, c, t, g, unknown or other
  modified_base (367)..(367): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattaccctatggcatgcacgtcgggtccnccagacctccgaggcgagggggctgggaggtgggtggctagtttattcgatagtgatagggaaatgtatacttntattcagtactccggtagaacgggccattccaccgtctaccgagagactaattccgagaccacgacgctgtactcgtagacaaatgaaacgagacctaggagagacgtaggacggacgacggtcttgtagtacgttaacgtggtacgaacggtaaatactttaacgttaagtaacggtagggttggtaaccggttacggggggtactttaccgg

SEQ ID NO: 410039 - DNA, 534 bp, Homo sapiens
  misc_feature: GZ8MTXP02GWLN3.11.71.G05.1.454.CMB.2.raw
  modified_base (307)..(307): a, c, t, g, unknown or other
  modified_base (341)..(341): a, c, t, g, unknown or other
  modified_base (372)..(372): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggagcgtggtccagcctgggagtccctgagactctcctgtacagcctctggcttcaccttcattacctatggcatgcacgtgggtccnccagactccgaggcgagggggctgggagtggggnggcagttattcatatgatggaatgtgacttntattcagctcgtgaggcatcaccgtctcagacgactacttccaggccacacgctagtatcctgacaaatgaaacagacctaggaacgacgcgtaggacggacgacgggctaggtagttaattaacgtggtacgtacgtaaaagtactttacgtagttaaggg

SEQ ID NO: 410040 - DNA, 551 bp, Homo sapiens
  misc_feature: GZ8MTXP02GKCYS.11.71.G05.1.454.CMB.2.raw
  modified_base (259)..(259): a, c, t, g, unknown or other
  modified_base (298)..(298): a, c, t, g, unknown or other
tcagcgagagataccacgaccggtgctcgatttagtgtcgtcgcaagagagaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggacgtccctgagactctcctgtacagcctntggcttcaccttcattacctatggcatgcacgtggtccnccagactccgaggcgaggggctggagtgggtgctagttattcatatgataggaaatgtgacttctattcagtacctcgtagaacgggcctattcaccgtctccagacgacacttccagcacacgctagtatctgacaaatgaaacagcctagagacgacgtagacggacaccggcttagtagttattacgtagtacgaacgtaaaagttactttacgtaagtaaggtaaggtacggtaaccggttaacggggg

SEQ ID NO: 410041 - DNA, 574 bp, Homo sapiens
  misc_feature: GZ8MTXP02JEN1Z.11.71.G05.1.454.CMB.2.raw
  modified_base (245)..(245): a, c, t, g, unknown or other
  modified_base (289)..(289): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggaggtccctgagactctcctgtacngcctctggcttcaccttcattaccatggcatgcacgtgggtccnccagcctcgaggcgaggggctggagtgggtgctagtttattcatatgagtaggaaatgtgtactttgtattcgagtaccgtcggtagaacgggcctattcccaccgtctccagacgacaacttccaggcacgacgtctagtactctagactaaatcgaaacagccgtagagagtcgtaggacggacacggtcgttgtacgttattacgtaggtacgaacggtaaagttacgtttaacgtaagttacggtaggtacggtaaccgggttacgggggtacgtttacgg

SEQ ID NO: 410042 - DNA, 587 bp, Homo sapiens
  misc_feature: GZ8MTXP02JOTYY.11.71.G05.1.454.CMB.2.raw
  modified_base (292)..(292): a, c, t, g, unknown or other
  modified_base (328)..(328): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggaggtccctgagactctcctgtacagcctctggcttcaccttcattacctatggcatgcacgtgggtcccnccagacctccgaggcgagggggctgggaggtggggnggctagtttattcatagtgaataggaaaattcgtagtactttctaattcgagtactccggtagaaacggggccctattcccaccgtctacccgaagacgactaacttccacggcacacgctgtatctagacaaatagaaacgacgccgtagaggagcgtaggaacggacgaccggtacgtgtagttaacttacgtacggtacgacgtaaagtagtttaacgtagtaggtaggtacgtacggtacgggggtactttacgg

SEQ ID NO: 410043 - DNA, 641 bp, Homo sapiens
  misc_feature: GZ8MTXP02IXZKZ.11.71.G05.1.454.CMB.2.raw
  modified_base (306)..(306): a, c, t, g, unknown or other
  modified_base (337)..(337): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggagtccctgagactctcctgtacagcctctggcttcaccttcattacctatggcatgcacgtggtccnccagctccgaggcgaggggctggagtggggngctagttattcatatgattggaatgtgtacttctattcgaagtactcccgtaggaacggggtcccgtaagttcccgtaacccgtcttaccccgaagtaacgaacctaaacgtttccccgaaagggtacccaaaccgaaccggtccttagggttaacttaccctagtaacctaaaagttacgaaaaccgaggtaccccgtaggaacggaacggccgtaagggacgggaaccgaacggtcgtaggttattaagtttaaccgtggtaggtacggtaaaagtttacgttttaacgtaagttaaacggg

SEQ ID NO: 410044 - DNA, 591 bp, Homo sapiens
  misc_feature: GZ8MTXP02JR4K3.11.71.G05.1.454.CMB.2.raw
  modified_base (244)..(244): a, c, t, g, unknown or other
  modified_base (248)..(248): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggtttcctcgttagctctttaagaggtgtccagtgtcaggtgcaactggaggagtctgggggaggcgtggtccagcctgggaggtccctgagactctcctgtacngctntgctcactcatacatgcatgcacgtggtccacagtactccacgtacgagggcgtggaggtgggtggcgtagttagttactatatagtagtagaaagtagtagtacttacttattctagtacgtaccgtaggaacgggtaccgtacttactaccgtacctaccacgaacgaactaaacttaccgacgacaacgacgtacgtacgtactactacgacaaagtaagaaacgaacgacgagagagacgtagagacgacggtacgtagtagttaacgttacgtacgtagtaacgtaaagtaattaagttaagtaagtaggtacggtacggtaacgggggtacggtacg

SEQ ID NO: 410045 - DNA, 583 bp, Homo sapiens
  misc_feature: GZ8MTXP02GPA23.11.71.G05.1.454.CMB.2.raw
  modified_base (252)..(252): a, c, t, g, unknown or other
  modified_base (297)..(297): a, c, t, g, unknown or other
  modified_base (437)..(437): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcgaggtgacaacgtggaggagtcggtgggggaggcgtggtccaggccgtgggacgtccctgagactctcctgtacngcctctggcttcaccttcattacctatggcatgcacgtgggtccnccagacctccgaggcgaggggctgggaggtgggtgctagtttattcatatgataggaaatgtgacttctattcagactccgtgaacgggcctattccacgtctccagagacaatcagcacacgctgtatctagactaaanacgaacacgacgtagagagacgtaggaacggaccgtacggtacgttaggttagttaacgttacgtacggtacgtaaacgtaaaagttactttaacgtaaagttaacggtacgggtacggtaaccgggtaccgggggtacgtttacg

SEQ ID NO: 410046 - DNA, 610 bp, Homo sapiens
  misc_feature: GZ8MTXP02HBH7O.11.71.G05.1.454.CMB.2.raw
  modified_base (258)..(258): a, c, t, g, unknown or other
  modified_base (305)..(305): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggacgtccctgagactctcctgtacngcctctggcttcaccttcattacctatggcatcgcacgtcgggtccnccagacctccgaggccgaggggctgggaggtgggtgctagtttatcatagtgataggaaaattgtcacttctattcagtactcgtagacgggtcctatccaccgtcacagagactactccgagaccacgacgctgtactcgtacgactaaagtacgaaacctacgacccgttaggaacggtacgtaccgtagggaacggaaccgtaccggtacgttaggttacggttaattaccgtaggttaacgtaacgtaaaacgtttgtttaacgtaaggtaggtacggttacggtaacgggttaccggggg

SEQ ID NO: 410047 - DNA, 557 bp, Homo sapiens
  misc_feature: GZ8MTXP02GR10W.11.71.G05.1.454.CMB.2.raw
  modified_base (265)..(265): a, c, t, g, unknown or other
  modified_base (310)..(310): a, c, t, g, unknown or other
  modified_base (380)..(380): a, c, t, g, unknown or other
  modified_base (413)..(413): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggaggcgtggtccagccgtgggaggtccctgagactctcctgtacngcctctggcttcaccttcattacctatggcatgcacgtgggtccnccagacctccgaggcgagggggctgggaggtgggtgctagtttattcatatgataggaatgtgtactttntattcagtactcgtgaaggcctattcaccgtcnccagagactatccgaggcacacgtctgtactctagacaaaagtcgaaacacggaccgtagaacgacgctagggaacggaaccgacggtcgtggttagttaagttaacgtgtacggacgtaaaaggtactttacgtaagtaacgg

SEQ ID NO: 410048 - DNA, 534 bp, Homo sapiens
  misc_feature: GZ8MTXP02F8IXS.11.71.G05.1.454.CMB.2.raw
  modified_base (433)..(433): a, c, t, g, unknown or other
  modified_base (486)..(486): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcactgggtcccgccagacctccgaggccgagggggctgggaggtggggtggctagttattcatatgataggaaataggtgacttctattcagacctccgtagaagggccgtattcgaccgtctcagagacaacttccaggcacncgctgtatctgacaaagtgaaacagcctagagagctagaggacacggatcgtnttattacgtgtgacgtaaagtcttatagtagaggtcgacgtacggggg

SEQ ID NO: 410049 - DNA, 569 bp, Homo sapiens
  misc_feature: GZ8MTXP02IHMYI.11.71.G05.1.454.CMB.2.raw
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctcctgtacagcctctggcttcaccttcattacctatggcatgcacgtgggtcccnccagcctccgaggccgaggggctggaggtgggtggctagtttattcatatgataggaaatgtgtacttctattcagtactccggtagaaacggggtccgtattcccgaccgtcctacccgtaagacgaactaaacgtttcccgaaggtaccaacacggactagtatctagactaaaatcgaaacagcctagacgagctagagacgacggtctagtgtacttacgtagtcgacgtaagtattaacgtagtagtaggtagacggtacggggtcgtttacg

SEQ ID NO: 410050 - DNA, 544 bp, Homo sapiens
  misc_feature: GZ8MTXP02F19UH.11.71.G05.1.454.CMB.2.raw
  modified_base (327)..(327): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggaggagtcgtgggggagcgtggtccagccgtgggagtccctgagactctcctgtacagcctctggcttcaccttcattacctatggcatgcactggtccgcagactccaggcaggggctggagtgggnggctagttatttcatatgataggaaaattgtcgactttctattcagactccggtagaaagggccgtattcacccgtctaccagacgacattccaggcacacgctgtatctagacaaaatgaaacagcctgagagctagagacacggctgtagttattacgtgtcggaagaaaagttactttacgtaagtaggtacggtacgtacggttaaccggggg

SEQ ID NO: 410051 - DNA, 572 bp, Homo sapiens
  misc_feature: GZ8MTXP02GDPOE.11.71.G05.1.454.CMB.2.raw
  modified_base (290)..(290): a, c, t, g, unknown or other
  modified_base (353)..(353): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacagcctctggcttcaccttcattacctatggcatgcacgtgggtcccnccagacctccgaggcgaggggctgggagtgggtggctagtttattcatatgataggaaatgtntactttctattcacgtaccttcggtagaaacgggccctattccgaccgtctccaagacgactaattccaggcacacgctgtatctagactaaatagaacacgcctagacgagctaggacgacgacggtcgttaggtagttacttacgtcgtacgaacgtaaacgttatttaacgtaagtaacggtacggtacggtaacggttacgggggtcgtttacgg

SEQ ID NO: 410052 - DNA, 534 bp, Homo sapiens
  misc_feature: GZ8MTXP02GYQY4.11.71.G05.1.454.CMB.2.raw
  modified_base (264)..(264): a, c, t, g, unknown or other
  modified_base (308)..(308): a, c, t, g, unknown or other
  modified_base (353)..(353): a, c, t, g, unknown or other
  modified_base (420)..(420): a, c, t, g, unknown or other
  modified_base (506)..(506): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcatgtgcaactggaggagtcgtgggggagcgtggtccagccgtgggagtccctgagactctcctgtacngcctctggcttcaccttcattaccatggcatgcactgggtcccnccagacctccagggcagggggctgggagtggggtgctagttattnatatgatggaaatgtgtacttctattcagtacctccgtaggaacggcgattccaccgtctaccaganactaacttccaggcacgacgctagatctagacaaatcgaaacagcctagagacgctaggaacggacgacggctgtagtaattacgnggttacgagtaaacgtactttactaaag

SEQ ID NO: 410053 - DNA, 613 bp, Homo sapiens
  misc_feature: GZ8MTXP02GY250.11.71.G05.1.454.CMB.2.raw
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggaggtccctgagactctcctgtacagcctctggcttcaccttcattaccctatggcatgcacgtgggtccnccagacctccgaggcagggggctggagtgggtgctagttattcatatgataggaaatgtgacttctattcagactccgtagtacggaccgtatacctacgtctaccagacgaactaacttaccgacggactaccgacgtacgtacgttactacttagactaaaacgttacgaaacgaacgacccgtagaggaacgaccgtaggaacgggtaccgaccggtacgtgttacggttaagttaccgtagttccgaaacggtaaacgttagtttaacgtaagttaacggtagggtacggtacggtaaccgggggttcggtttaccgg

SEQ ID NO: 410054 - DNA, 595 bp, Homo sapiens
  misc_feature: GZ8MTXP02FUHKY.11.71.G05.1.454.CMB.2.raw
  modified_base (293)..(293): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcacgtcgggtcccnccagacctccgagggcgagggggctgggaggtggggtggctaggtttatttcattatgatggaaatgtgtacttctattcagactccggtagaacgggtccattccaccgtctcccagagacaattccacggacacacgctagtactctgacaaatagaaacagaccgtagaagagacgtaggaacggacgacggtacgttggttagttacgtttacgtacggtacgtaacggtaaaagttatttaacgtaagttaacggtaaggggttacggtaacgggttaaccgggggtcgtttaccgg

SEQ ID NO: 410055 - DNA, 549 bp, Homo sapiens
  misc_feature: GZ8MTXP02GP8O2.11.71.G05.1.454.CMB.2.raw
  modified_base (293)..(293): a, c, t, g, unknown or other
  modified_base (340)..(340): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggaggtccctgagactctcctgtacagcctctggcttcaccttcattaccctatggcatgcacgtgggtccnccagacctccgaggcgagggggctgggagtggggtgctagtttattnatatgataggaaatgtgacttctattcagtactccggtagaagggccattccaccgtctccagagacaattccaggcacacgctgtactctagactaaatgaaacagcctagacgagctaggaggacgacggctcggtagttacttacgtgtacgacgtaaagtatttaacgtaagtaggtacggtagacggtacgggggtcgtttacg

SEQ ID NO: 410056 - DNA, 540 bp, Homo sapiens
  misc_feature: GZ8MTXP02FVU2V.11.71.G05.1.454.CMB.2.raw
  modified_base (306)..(306): a, c, t, g, unknown or other
  modified_base (403)..(403): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggacgtccctgagactctcctgtacagcctctggccttcaccttcattaccatggcatgcacgtgggccnccagactccgaggcgaggggctgggagtggggtgctagtttattcatatgataggaatcgtgtacttctattcagtactcgtgaggcgatcacgtcncagacacatcgagcacactcgtatactctagacaaagtcgaaacacgcctagacgacgcgtaggacggaacgacggtcgtacggttgttaacgttaacgtcggtagtacggtaaaagttactttacgtaagtaaggg

SEQ ID NO: 410057 - DNA, 505 bp, Homo sapiens
  misc_feature: GZ8MTXP02F4MPF.11.71.G05.1.454.CMB.2.raw
  modified_base (289)..(289): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccnccagactccaggcagggggctggagtgggtggcagttatttcatatgatggaaatgtgacttctattcagactccgtgaagggccattcaccgtctccagagacaatccaggcacacgctgtatctgacaaatgaaacagcctgagagctgagacacggctgtgtattactgtacgacgaaagattaactatagaggtgacgtacgggggcttacg

SEQ ID NO: 410058 - DNA, 574 bp, Homo sapiens
  misc_feature: GZ8MTXP02JQJ3I.11.71.G05.1.454.CMB.2.raw
  modified_base (257)..(257): a, c, t, g, unknown or other
  modified_base (262)..(262): a, c, t, g, unknown or other
  modified_base (275)..(275): a, c, t, g, unknown or other
  modified_base (300)..(300): a, c, t, g, unknown or other
  modified_base (459)..(459): a, c, t, g, unknown or other
  modified_base (466)..(466): a, c, t, g, unknown or other
tcagcgagagataccacgaccggtgctcgatttagtgtcgtcgcaagagagaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtggggacgtccctgagactctcctgtacngcctntggcttcaccttnattaccatggcatgcacgtggtccncagacctccgaggcgagggggctgggacggtgggtgctagtttatttcatatcgagtaggaaaactggtgactttctattcaagtctccgtaggaaacgggccgattccaccgtcctccagagacaactccgaggcacgacgctagtactctgacaaangaaaccncgacgagagacgcgtaggaacggacgtacgcgtacgttacgttactacgtcgtacggaacgtaaagttactttacgtagtaacggtacggtacggtacgggaacgggg

SEQ ID NO: 410059 - DNA, 503 bp, Homo sapiens
  misc_feature: GZ8MTXP02JY8X3.11.71.G05.1.454.CMB.2.raw
  modified_base (418)..(418): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagacctccaggcagggggctgggagtgggtggcagttatttcatatgatggaaatgtgactctattcagactccgtgaaggcattcaccgtctccagagacaatccagcacacgctagatctagacnctgaacagcctgagagctgacgacacggctgtgtactacgtgcgacgaaagtattcgtagtagacggtagacgtacggggcttcg

SEQ ID NO: 410060 - DNA, 550 bp, Homo sapiens
  misc_feature: GZ8MTXP02J28KD.11.71.G05.1.454.CMB.2.raw
  modified_base (252)..(252): a, c, t, g, unknown or other
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctggggaggtccctgagactctcctgtacagcctntggcttcaccttcattaccatggcatgcacgtgggtccncagacctccgaggcgagggggctgggagtgggtggctaggttatttcatagtgatagggaaatgtgacttctattccagacctcgtgaaggggcctattccaccgtctccagacgacatcagcacacgctgtactctagacaaatgaacgagaccgtagacgaacgcgtagacggacgacggtcgtagtagtacttacgtcgtagacgtaaagtatttaacgtaagtacggaggtacggacggtacgggggtctttcgg

SEQ ID NO: 410061 - DNA, 589 bp, Homo sapiens
  misc_feature: GZ8MTXP02GPOJC.11.71.G05.1.454.CMB.2.raw
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggaggtccctgagactctcctgtacagcctctggcttcaccttcattacctatggcatgcactgggtccnccagacctccgaggcgagggggctgggagtggggtgctaggtttattcatatgaagtggaaatgtgtactttctattcagtactcgtagaacgggtccattccaccgtctaccagacgactaacttccgaggtcacgacgtctgtactctagactaaatcgaacagcctaggagtagacgtaggaacggacgaccgggtactaggttagttaacgtttacggtagtacggaacgtaaaaggttactttaacgtaagtacggtaggggtacgaaccgggttacgggggtcttttaacgg

SEQ ID NO: 410062 - DNA, 548 bp, Homo sapiens
  misc_feature: GZ8MTXP02HRLXM.11.71.G05.1.454.CMB.2.raw
  modified_base (304)..(304): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagccgtgggagtccctgagactctcctgtacagcctctggcttcaccttcattacctatggcatgcacgtgggtcccnccagctccgaggccgagggggctgggaggtggggtggctagtttattcattatgatggaaattgtgtattctattcagacctcgtagaacggccgattcaccgtctcagagacaattccaggcacacgctagtactctagacaaatgaaacagcctagagagcgtaggacgacgacggtctgtagttacttacgtgttacgagtaaagtactttacgtagtagaggtacgtacggttacggggg

SEQ ID NO: 410063 - DNA, 573 bp, Homo sapiens
  misc_feature: GZ8MTXP02IWY0Z.11.71.G05.1.454.CMB.2.raw
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccagcctgggagtccctgagactctcctgtacagcctctggcttcaccttcattaccatggcatgcacgtgggtcccnccagacctccgaggcgagggggctgggaggtggggtggctagtttatttcatatgataggaaatagtgactttcattcagactccgtagaacgggcgtattccacccgtctaccgagacgactaacttccgacggcacgacgctagtatctagacaaatcgaacgtacgcctagagacgcgtaggaacgacgacggtctaggttagttacgttaacgtcggtagaaccgtaaagtagtttaactagtaacggaggtaggaccggtacgggggtcgtttacgg

SEQ ID NO: 410064 - DNA, 582 bp, Homo sapiens
  misc_feature: GZ8MTXP02HHLFM.11.71.G05.1.454.CMB.2.raw
  modified_base (290)..(290): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggaggagtcgtgggggaggcgtggtccagcctgggaggtccctgagactctcctgtacagcctctggcttcaccttcattacctatggcatgcactggtccnccagcctccaggcagggggctgggagtggggtgctagttatttcatatgataggaaatgtgactttctattcgagtactcccggtagaaggggccctaagttccacccgttctcccgaagacgactaacttcccgaggcacaccgctagtactctagactaaatcggaaactacgaccgtagaggagacgtaggacggaacgacggtctaggttagttacttacgtgtacgacgtaaaagttatttaacgtaagttaagggacggtaggtaccggtacggggggtctttcgg

SEQ ID NO: 410065 - DNA, 644 bp, Homo sapiens
  misc_feature: GZ8MTXP02GD9RR.11.71.G05.1.454.CMB.2.raw
  modified_base (255)..(255): a, c, t, g, unknown or other
  modified_base (300)..(300): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggagtccctgagactctcctgtacngcctctggcttcaccttcattacctatggcatgcacgtgggtccnccagacctccgaggcgagggggctggaggtggggtggctagttattcatagtgatggaaaatgtagacttctattcagacctccgtaggaaaggggtcccgtaattccaacccggttctacccgaagaacgtaacctaaactttcccgaagggaccaccaacggtccttaggtaactcgttacgaacctaaaagttacgaaaaccaagcccttaggaacgaagccgtaggaacggaaccgaacgggtccttaggttacgttaagtttaccgtacgtaggtaaccggtaaaagttagttttaacctaagttacggtaacggttaggtaaccggtttaacgggggg

SEQ ID NO: 410066 - DNA, 552 bp, Homo sapiens
  misc_feature: GZ8MTXP02JL77D.11.71.G05.1.454.CMB.2.raw
  modified_base (307)..(307): a, c, t, g, unknown or other
  modified_base (365)..(365): a, c, t, g, unknown or other
  modified_base (517)..(517): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggacggtccctgagactctcctgtacagcctctggccttcaccttcattacctatggcatgcacgtcgggtccncagacctccgaggcgaggggctgggagtgggtgctagttattcatatgatagaaatgntacttctattcagtacctcgtagaacggctatcaccgtctcagacgacaactcagcacacgtctagtatctagacaaatacgaacagcctagacgagacgaggaacgacgacggtactcgtagttaacttacgtacgtagaacgtaaaagtntttacgtaagtagtacggtacggtacggtacgggg

SEQ ID NO: 410067 - DNA, 528 bp, Homo sapiens
  misc_feature: GZ8MTXP02JOU30.11.71.G05.1.454.CMB.2.raw
  modified_base (290)..(290): a, c, t, g, unknown or other
  modified_base (355)..(355): a, c, t, g, unknown or other
  modified_base (392)..(392): a, c, t, g, unknown or other
  modified_base (414)..(414): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactcgggtccnccagactccaggcagggggctgggagtggggtggcagttatttcatatgatggaaatgtgacttntattcagactcgtgaaggccattcaccgtctccaganacaattcaggcacacgctgtanctgacaaatgaacagcctagagtagctaggacgacgacggtctaggttgtaacttcgtagtgaacgtaaagtactttaagaataggaggttcgacggttacggggtctttacgg

SEQ ID NO: 410068 - DNA, 530 bp, Homo sapiens
  misc_feature: GZ8MTXP02F0C8O.11.71.G05.1.454.CMB.2.raw
  modified_base (292)..(292): a, c, t, g, unknown or other
  modified_base (352)..(352): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcacgtgggtcccncagacctccgaggcgagggggctgggagtgggtgctagttattcatatgatggaaatgtnacttctattcagactcgtagaacgggcattcaccgtctccagacgacaatccgagcacacgctgtatctgacaaatgaacagcctagacgagctggaggacgacggctggtgttattacgtgtagacgtaaagtatttaacgtaagtaggaggtaggtacggtacggggtcgtttacg

SEQ ID NO: 410069 - DNA, 580 bp, Homo sapiens
  misc_feature: GZ8MTXP02INHDJ.11.71.G05.1.454.CMB.2.raw
  modified_base (248)..(248): a, c, t, g, unknown or other
  modified_base (253)..(253): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagcctgggacgtccctgagactctcctgtacngcctntggcttcaccttcattacctatgcatgcacgtcgggtcccgccagactccgaggcgagggggctgggaggtgggtggactagttatttcatatgataggaaattagtgtacttactattcagacttccggtagaacggggcctattcccaccgtcacagacgactaacttccagcacgacgctagtatctagactaaatagaacacgccgtagagtagcgtaggaacggacgacggtcttaggttagttacgttaacgtggtacgaacgtaaagttatttaacgtaagttaaggtacggtagtaacgggtacgggggtacgtttacg

SEQ ID NO: 410070 - DNA, 560 bp, Homo sapiens
  misc_feature: GZ8MTXP02FOH9U.11.71.G05.1.454.CMB.2.raw
  modified_base (246)..(246): a, c, t, g, unknown or other
  modified_base (292)..(292): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggaggtccctgagactctctgtacngcctctggcttcaccttcattacctatggcatgcacgtgggtcccncagactccgaggcgagggggctgggagtgggtgctagtttattcatatgataggaaatgtgacttctattcagactcgagaacgggccattccaccgtctccagacgacaattccaggcacacgctgtatctagacaaatacgaaacagacctagaggagcgtaggaaggacgaacgggtcttaggttagttacttacgtggtacgaacgtaaagttatttaacgtaagtaacggtagggtagtaacgggtacgggggtcgtttacgg

SEQ ID NO: 410071 - DNA, 593 bp, Homo sapiens
  misc_feature: GZ8MTXP02INZHL.11.71.G05.1.454.CMB.2.raw
  modified_base (245)..(245): a, c, t, g, unknown or other
  modified_base (292)..(292): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctcctgtacngcctctggcttcaccttcattacctatggcatgccacgtgggtcccnccagacctccgaggcgagggggctgggaggtggggtggctagtttattcatatgaatagggaaattgtgtactttctaattcagtactccggtagaacggggcctattccaccgtctccagaacactaattccaggacacacgctgtatctagactaaagtacgaactacgcctaggacgagcgtaggaacggacgacggtacgtaggttgttaacgtttacgtggtacggaacgttaaaagttactttaacgtaagttaaggtaggttacggtaaccggttacgggggttacgtttacgg

SEQ ID NO: 410072 - DNA, 599 bp, Homo sapiens
  misc_feature: GZ8MTXP02GR86E.11.71.G05.1.454.CMB.2.raw
  modified_base (306)..(306): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctctgtacagcctctggcttcaccttcattacctatggcatgcacgtgggtccncagactccgaggcgagggggctgggagtgggtgcagttattcatatgataggaatgtgtacttctattcagtactccgtagaacgggcccgtattccgacccgttcctacccgaagaacgactaaacgttccaagggccaacgaaccggccttaggtactcttacgacctaaaatcgaaacacgacccgtagaagtacggacctaggaacggaaccgtaaccgggcgttacggttacgtaagtttaacgtagttaggtaacggaaaagtttacgtttacgtaagttaacgggg

SEQ ID NO: 410073 - DNA, 523 bp, Homo sapiens
  misc_feature: GZ8MTXP02IY04Z.11.71.G05.1.454.CMB.2.raw
  modified_base (306)..(306): a, c, t, g, unknown or other
  modified_base (316)..(316): a, c, t, g, unknown or other
  modified_base (354)..(354): a, c, t, g, unknown or other
tcagcgagagataccacgaccggtgctcgatttagtgtcgtcgcaagagagagggggagctctgggagaggagcccagcaatagaagtcggcggtgtttccattcggtgatcagcactgaacacagaggactcaccatggagtttgggctgagcgtgggttttcctcgttgctcttttaagaggtgtccagtgtcaggtgcaacgtggaggagtcgtgggggaggcgtggtccaggccgtggggacgtccctggagactctcctgtacagccctctggccttcaccttcattacctatggcatgcncgtcggtccncagcctcgaggcgaggggctgggagtgggtgctagttntcatatgattaggatgtgtacttctattcagtctcgtagaggccattccacgtcacagacgacatccagcacacgtcagtatactagacaaatcgaacacgcgtagagacgcgtagacggacgacggtctacgtattactgtagacgtacgtaatacttacgtagtagg

SEQ ID NO: 410074 - DNA, 515 bp, Homo sapiens
  misc_feature: GZ8MTXP02IZB6K.11.71.G05.1.454.CMB.2.raw
  modified_base (289)..(289): a, c, t, g, unknown or other
  modified_base (349)..(349): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggagcgtggtccagcctgggaggtccctgagactctcctgtacagcctctggcttcaccttcattacctatggcatgcactgggtcccnccagacctccgaggcagggggctggagtggggtgcagtttattcatatgatggaaatgtnacttctattcagactccgtgaagggccattcaccgtctccagagacaattcaggcacacgctgtatctgacaaatcgaactagccctagagagctggagacgacggctgtgtattactggttagacgaaagtatttcgaatagaggtggactcgggggtactttcg

SEQ ID NO: 410075 - DNA, 553 bp, Homo sapiens
  misc_feature: GZ8MTXP02F9Z9V.11.71.G05.1.454.CMB.2.raw
  modified_base (292)..(292): a, c, t, g, unknown or other
  modified_base (510)..(510): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattaccctatggcatgcacgtgggtccnccagacctccgaggcgagggggctgggaggtgggtggctagtttattcatatgataggaaatgtgtacttctattcagtacttaccggtaagggcctattccaccgtctccagacgacatccagcacacgctgtactctcgactaaatgaaacacgcctagagagtcgtaggacggacgacgggtctggttacgttattacgtgtagacgtaaaagtntttacaagtaggaggtacggacgttacgggggtcttgtttacg

SEQ ID NO: 410076 - DNA, 572 bp, Homo sapiens
  misc_feature: GZ8MTXP02GIU4U.11.71.G05.1.454.CMB.2.raw
  modified_base (314)..(314): a, c, t, g, unknown or other
  modified_base (378)..(378): a, c, t, g, unknown or other
  modified_base (477)..(477): a, c, t, g, unknown or other
  modified_base (490)..(490): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggagcgtggtccagccgtgggacgtccctgagactctcctgtacacgcctcgtggcttcaccttcattacctatggcatgctacgtcgggtcccncagacctcgaggcgaggggctgggaggtggtggctagttattcatatgataggatgtatacttntattcgagtaccttccgtagaacggtccgtacttccgacccgttaccaccgaagtaacgaactaacgtcgaacgtaccacacgtctagtactgacgaanaaagtacgaaacncgacgagacgacgacgaggacgacgtacgtacgttagtacttagtaacgtgtacgtaaacgtaagtttactaacgtagtagg

SEQ ID NO: 410077 - DNA, 567 bp, Homo sapiens
  misc_feature: GZ8MTXP02IV0YY.11.71.G05.1.454.CMB.2.raw
  modified_base (264)..(264): a, c, t, g, unknown or other
  modified_base (308)..(308): a, c, t, g, unknown or other
  modified_base (478)..(478): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccagccgtgggacgtccctgagctctcctgtacngcctctggcttcaccttcattacctatggcatgcacgtggcccncagcctccgaggcgaggggctgggagtggggtgctagtttattcgatagtgataggaatgtgtactttctattcaagtacctccgtagaacggccgtattccgacccgtctacccgaagacgaacaacttccgagaccacacgtctagtactctagacaaaatcgaaacncgacgtagagacgtcgaggacggaccgacggtcgttacgttagttacgttaacgtggtacgaacgtaaagttactttacgtaagtaagg

SEQ ID NO: 410078 - DNA, 605 bp, Homo sapiens
  misc_feature: GZ8MTXP02HDBYS.11.71.G05.1.454.CMB.2.raw
  modified_base (164)..(164): a, c, t, g, unknown or other
  modified_base (259)..(259): a, c, t, g, unknown or other
  modified_base (265)..(265): a, c, t, g, unknown or other
  modified_base (307)..(307): a, c, t, g, unknown or other
  modified_base (379)..(379): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcgtggtttccncgttgctctttaagaggtgtccagtgtcaggtgcaactggaggagtcgtgggggagcgtggtccagcctgggagtccctgagactctcctgtacngcctcnggcttcaccttcattacctatggcatgcacgtcggggtcccnccagcctccgaggcggaggggctgggaggtggggtgctagtttattcatagtgagtaggaatgtactacttntattcgagtacctcgtaggaacgggccgtacgttccgacccgtctaccgagaacgaactactaccgaaggaccaccgacgtctagtactacgtacgaacaaactaacgaaacgacgaccgtacgaacgacgacgtacggaacggaacggaacggtacgtacgttagttacgttaacgttacggtacggtaacggtaaaacgttaacgtttaacgttaacgtaacgg

SEQ ID NO: 410079 - DNA, 563 bp, Homo sapiens
  misc_feature: GZ8MTXP02J1K2X.11.71.G05.1.454.CMB.2.raw
  modified_base (302)..(302): a, c, t, g, unknown or other
  modified_base (371)..(371): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggaggcgtggtccagcctgggacggtccctgagactctcctgtacagcctctggcttcaccttcattacctatggcatgcactgggtccnccagactccgaggcgagggggctgggaggtggggtgctagtttattcatatgatggaaatgtgtacttntattcagactccgtagaacgggccgattccaccgtctccagagacaacttccaggcacacgctgtactctgacaaagtcgaaacacgacctaggagagacgtaggaagaccgaacggcgtggtacgtagttacgtggtacgtaacgtaaagtacgtttactaagtaggaggttacggacggtttaccggggg

SEQ ID NO: 410080 - DNA, 542 bp, Homo sapiens
  misc_feature: GZ8MTXP02HQO21.11.71.G05.1.454.CMB.2.raw
  modified_base (265)..(265): a, c, t, g, unknown or other
  modified_base (311)..(311): a, c, t, g, unknown or other
  modified_base (346)..(346): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtggggaggtccctgagactctcctgtacngcctctggcttcaccttcattacctatggcatgcacgtgggtcccnccagacctccgaggcgagggggctgggagtggggngctagtttatttcatatgataggaatgtgactttctattcagtactccgtgaggcattcaccgtctaccagacgacaacttcagcacacgtctgtatctgacaaatgaaacagacctagaagacgcgtaggacggacgacggcgtcggttgttagttaacgtgtaggacgtaaaagttactttacgttaagtaagg

SEQ ID NO: 410081 - DNA, 561 bp, Homo sapiens
  misc_feature: GZ8MTXP02HHFOM.11.71.G05.1.454.CMB.2.raw
  modified_base (300)..(300): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggagtccctgagactctcctgtacagcctctggcttcaccttcattacctatggcatgcactggtccncagactccaggcagggggctgggagtgggtgcagtttattcatatgatgggaaattgtgacttctattcaagtactccgtaggaaacgggtccgattcacccgtctccgagacgactaactcagcacacgctgtactctagactaaagtagaaacagcctagacgagtctaggacggaccacggctagttacgtacgtttactggtaggaacgtaaaagttatttacgtagtaaggtaaggtacgtaacgggtaccggggg

SEQ ID NO: 410082 - DNA, 535 bp, Homo sapiens
  misc_feature: GZ8MTXP02GFRDD.11.71.G05.1.454.CMB.2.raw
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctcctgtacagcctctggcttcaccttcattacctatggcatgcactgggtccgccagactccgaggcgagggggctgggagtggggtgcagttattcatatgattgaatgtgacttctatcagactcgtgaggcatcacgtctccagacgacacttcaggcacacgctgtactctagaccaaatacgaaacagaccgtagacgagccgtaggacggacgacggcgttcggtagttagttaaccgtgtacggtacgtaaaagtactttacgtaagttaaaggg

SEQ ID NO: 410083 - DNA, 628 bp, Homo sapiens
  misc_feature: GZ8MTXP02FJVOH.11.71.G05.1.454.CMB.2.raw
  modified_base (299)..(299): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggaggcgtggtccaggccgtggggaggtccctgagactctcctgtacagcctctggtcttcaccttcattaccctatggcatgcacgtgggtcccncagacctccgagggcgagggggctgggagtggggtggctaggtttatttcatatgatggaaaatgtgtacttcttattcgagtccgttcggtagaacggggtcctagttccacccgtcctacccgaagtaacgtaactaacttacccgaggaccaaccgacgtactgtactctagactaaatacgaaactagcccgtagacgtagcgtaggaacggtacgaacgggtcttaggttacgttaacgtttacgtaggtacgtaaccggaaagtttacgtttaacgtaagtaacggtaggggtacgtaaccgggttacgggggtcgtttacgg

SEQ ID NO: 410084 - DNA, 601 bp, Homo sapiens
  misc_feature: GZ8MTXP02JAYLX.11.71.G05.1.454.CMB.2.raw
  modified_base (261)..(261): a, c, t, g, unknown or other
  modified_base (310)..(310): a, c, t, g, unknown or other
  modified_base (390)..(390): a, c, t, g, unknown or other
  modified_base (565)..(565): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggaggcgtggtccagccgtgggacgtccctgagactctcctgtacngcctctggcttcacccttcattacctatggctatgcacgtcgggtcccncagacctccgaggcgagggggtctggggaggtggggtgcgtagtttattcattagtgagtagggaaattggtgtactttntattcaggtacctccggtagaacgggcccgtattccaccgtctaccgagacgtacattccagaccacagtatagtatcgtagacctaaagtacgaaacgacgtcctaggaggacgccgtaggacggaacgtacggtcgtcggttagttattacgtagtagtaaccggtaaagttntttaacgtagtagtaggtacgtaacggttacggggg

SEQ ID NO: 410085 - DNA, 559 bp, Homo sapiens
  misc_feature: GZ8MTXP02GN9KS.11.71.G05.1.454.CMB.2.raw
  modified_base (290)..(290): a, c, t, g, unknown or other
  modified_base (335)..(335): a, c, t, g, unknown or other
  modified_base (349)..(349): a, c, t, g, unknown or other
  modified_base (355)..(355): a, c, t, g, unknown or other
  modified_base (367)..(367): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacagcctctggcttcaccttcattacctatggcatgcacgtcgggtccnccagacctcgaggcgagggggctgggagtggggtgctagttattnatatgatggaatgntacttntatcagctccgngaacgggcctattccaccgtctccgagacgacactccgaggacacacgctagtatctagactaaagtacgaacagacctaggagtagaccgtaggacggacgacggtcgtagtagtacttacgtcgtagaccgtaaagttacgttaacgtaagtaacggtagtacggtacggtacgggggtacgtttaccgg

SEQ ID NO: 410086 - DNA, 523 bp, Homo sapiens
  misc_feature: GZ8MTXP02IQQMU.11.71.G05.1.454.CMB.2.raw
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcacgtgggtcccgccagacctccaggcagggggctgggagtggggtggctagtttattcatatgatggaaatgtgacttcattcagtactccgtgaagggccgattcaccgtctccagagacaatcagcacacgctgtatctgacaatgaacagcctagagagctgagacacggctgtagtacttacgtgtcgaacgtaagttacttaagtagtaggtagtaggtacgtacgggggtactttcg

SEQ ID NO: 410087 - DNA, 554 bp, Homo sapiens
  misc_feature: GZ8MTXP02F1Q2N.11.71.G05.1.454.CMB.2.raw
  modified_base (262)..(262): a, c, t, g, unknown or other
  modified_base (267)..(267): a, c, t, g, unknown or other
  modified_base (308)..(308): a, c, t, g, unknown or other
  modified_base (415)..(415): a, c, t, g, unknown or other
  modified_base (450)..(450): a, c, t, g, unknown or other
  modified_base (466)..(466): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggagtccctgagactctcctgtacngcctnggccttcaccttcattacctatggcatgcacgtcgggtccncagctccgaggcgaggggctggaggtgggtgctagtttattcaatatgatagggaatgtcgtacttctattcaagtacctcggtagaacggcctattccaccgttcnccaagacgacaaactccgaagccacacgctgtacnctagacaaatcaaacngacctagaagacgcgtaggaacggtacgacggtcttagtacgttaacttaacgtaggtagaacgtaaagttatttacgtagttaaggg

SEQ ID NO: 410088 - DNA, 570 bp, Homo sapiens
  misc_feature: GZ8MTXP02FPPS7.11.71.G05.1.454.CMB.2.raw
  modified_base (264)..(264): a, c, t, g, unknown or other
  modified_base (305)..(305): a, c, t, g, unknown or other
  modified_base (367)..(367): a, c, t, g, unknown or other
  modified_base (372)..(372): a, c, t, g, unknown or other
  modified_base (401)..(401): a, c, t, g, unknown or other
  modified_base (406)..(406): a, c, t, g, unknown or other
  modified_base (417)..(417): a, c, t, g, unknown or other
  modified_base (420)..(420): a, c, t, g, unknown or other
  modified_base (426)..(426): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggacgtccctgagactctcctgtacagcctntggcttcaccttcattacctatggcatgcacgtgggtcccnccagacctccgaggcgagggggctgggagtgggtgctagttattcatatgataggaaatgtnacttntatcagactcgtgaaggcctatcacgtcncaganacatcagcacncgntgatcngacaaatacgaaacacgcctagaacgagaccgtagaacggaaccgacggtccttaggttacggttaaatttacgtacggtagtaacgtaaaagttacttttacgtaaagtagggtaaggttcggaaaccgggtttaaccggggg

SEQ ID NO: 410089 - DNA, 539 bp, Homo sapiens
  misc_feature: GZ8MTXP02HME0M.11.71.G05.1.454.CMB.2.raw
  modified_base (249)..(249): a, c, t, g, unknown or other
  modified_base (256)..(256): a, c, t, g, unknown or other
  modified_base (290)..(290): a, c, t, g, unknown or other
  modified_base (353)..(353): a, c, t, g, unknown or other
  modified_base (440)..(440): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggtttctcgttgctctttaagaggtgtccagtgtcaggtgcaacgtggaggagtcgtgggggagcgtggtccagccgtgggacgtccctgagactctcctgtacagcctntgcttcnccttcattacccatggcatgctacgtcgggtccnccagacctccgaggcgaggggctgggagtgggtgctagtttattcatatgagtagaaatcgtntattctatcgagtctccgtagaacggctatccacgtctacagacactactcacgacacacgtctatatctagaactaagtgaaaccncgcgagacgacgacgaggacgacgacgtcgtagtagtacgtagtagtacgtaacgtaattattaagtagtacggtacggtacggacggtacggtcttcg

SEQ ID NO: 410090 - DNA, 534 bp, Homo sapiens
  misc_feature: GZ8MTXP02F14MO.11.71.G05.1.454.CMB.2.raw
  modified_base (246)..(246): a, c, t, g, unknown or other
  modified_base (251)..(251): a, c, t, g, unknown or other
  modified_base (257)..(257): a, c, t, g, unknown or other
  modified_base (260)..(260): a, c, t, g, unknown or other
  modified_base (265)..(266): a, c, t, g, unknown or other
  modified_base (268)..(270): a, c, t, g, unknown or other
  modified_base (272)..(272): a, c, t, g, unknown or other
  modified_base (280)..(280): a, c, t, g, unknown or other
  modified_base (285)..(285): a, c, t, g, unknown or other
  modified_base (288)..(288): a, c, t, g, unknown or other
  modified_base (292)..(292): a, c, t, g, unknown or other
  modified_base (300)..(300): a, c, t, g, unknown or other
  modified_base (305)..(305): a, c, t, g, unknown or other
  modified_base (307)..(307): a, c, t, g, unknown or other
  modified_base (317)..(317): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggtttcgcgttaggctcttttaagaggtgtccagtgtcaggtgcaactgggaggagtcgtgggggagcgtggtccagcctgggaggtccctgagactctcctgtacngcctntgctcnctnatacnngnnncngtcggccncagcncgngcgngggctggngtggngngtagttattntatatagagtagtaagtagtatatacttatcagactcgtagagtacgtactcacgtctacagagacactacgacgacacacgactgtactactagactaatacgaacgacgacgtagagagacgagacgacgacggtacgtgtagttacgttacgtacgtacgtacgtaacgtagttaagtagtacgtacggtacggtacggtacgggtacggtacg

SEQ ID NO: 410091 - DNA, 749 bp, Homo sapiens
  misc_feature: GZ8MTXP02HUW5V.11.71.G05.1.454.CMB.2.raw
  modified_base (300)..(300): a, c, t, g, unknown or other
  modified_base (338)..(338): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcgtgggttttcctcgttgcttcttttaagaggtgtccagtgtcaggtgcaactggaggagtcgtgggggaggcgtggtccagccgtgggacgtcctgagactctcctgtacagcctctgcttcaccttcattacatgcatgctacgtgggtccnccagacctccgaggacgagggggctgggaggttggggngctagtttattcgaattgtagaagtaggaaaattgtacgtactttcgttattacaacgttaccgttccgggtaggtaaacgggtcccgtacgttacccgtaacccggttacgttaacccgaaggaaccgtaaaccgttaaacctttacccgaaacgggtacccaaaccggaaccggtacctttaggttaaactttcccgttaaggtaaaccaaaaggttaaccaaaacgaccggtacccgtaaggtaacggaggaccgtaagggaaccggtaacggaacccgggtacgtacggtttaacggtttaaatttaccggttacggtaccggtaaaacgggaaaaacgtttttactttaaacgtttaaacggttaaggtaacggggttaccggttaacgggggtttaacccggggg

SEQ ID NO: 410092 - DNA, 576 bp, Homo sapiens
  misc_feature: GZ8MTXP02J0RLF.11.71.G05.1.454.CMB.2.raw
  modified_base (264)..(264): a, c, t, g, unknown or other
  modified_base (309)..(309): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccaggccgtgggacgtccctgagctctcctgtacngcctctgcttcaccttcattacctatggcatgcactcgggtcccnccagactccgaggcgagggggctggaggtggggtggctagttattcatatgataggatgtgtacttctattcgagtctccgtggaacggccgtattccaccgtctccgagacgaactacgttccaggcaccgacgcttagtactctagacaaatcgaaacacgcctaggagacgcgtagggaacggaccgacggggtcttaggttacgtttaacgttaacgttacggtaggtacggtaaaagttacgttttaacgtaagttaacggg

SEQ ID NO: 410093 - DNA, 550 bp, Homo sapiens
  misc_feature: GZ8MTXP02JZHQS.11.71.G05.1.454.CMB.2.raw
  modified_base (248)..(248): a, c, t, g, unknown or other
  modified_base (253)..(253): a, c, t, g, unknown or other
  modified_base (293)..(293): a, c, t, g, unknown or other
  modified_base (362)..(362): a, c, t, g, unknown or other
  modified_base (449)..(449): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactgggaggagtcgtgggggaggcgtggtccagcctgggacgtccctgagactctcctgtacngcctntggcttcaccttcattaccatggcatgcacgtggggtccnccagcctccgaggcgagggggctgggagtggggtgctagtttattcatatggaatagggaaaatggtanactttctatccgagacctccggtagaacgggcctattccaccgtactacagagacaactcgacggcacacgctagtactcagacaanagaacacgacgacgagagcgagacgacgacgcgtgtagtacgtacgtacgtacgacgaagtagttaagtagtagtaggtagtacggtacgggtacgttacg

SEQ ID NO: 410094 - DNA, 553 bp, Homo sapiens
  misc_feature: GZ8MTXP02GFZHQ.11.71.G05.1.454.CMB.2.raw
  modified_base (245)..(245): a, c, t, g, unknown or other
  modified_base (291)..(291): a, c, t, g, unknown or other
  modified_base (325)..(325): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctcctgtacngcctctggcttcaccttcattaccctatggcatgcactgggtcccnccagactccgaggcgagggggctgggaggtgggngcagtttattcatatgataggaaatgtgacttctattcagtactccggtagaacgggccgtattccaccgtctacccagacgacaattccaggcacacgctagtatcctagacaaatcgaaactacgcctagacgagctaggacgacgacggctgtattacttacgtagtcgaacgtaaagttatttaagtagtacggtaggtaggtacggtacgggggtctttacgg

SEQ ID NO: 410095 - DNA, 590 bp, Homo sapiens
  misc_feature: GZ8MTXP02HHTNX.11.71.G05.1.454.CMB.2.raw
  modified_base (264)..(264): a, c, t, g, unknown or other
  modified_base (311)..(311): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggagtccctgagctctcctgtacngcctcgtggcttcaccttcattacctatggcatgctacgtgggtccnccagctccgaggcgaggggctgggagtgggtgctagtttattcatatgataggatgtgactttctattcagtacctccgtagaacggccgtattcgacccgttctaccgagacgtaacaattccgaggtacaacacgtctagttactcctagactaaaagtacgaaacacggtacctagacgagtcgtaggaacgggaaacgaccggtacgttcggttacgttaagttaaccgtaggtacgtaacggtaaagtttacctttacgttaaggtttaacggg

SEQ ID NO: 410096 - DNA, 614 bp, Homo sapiens
  misc_feature: GZ8MTXP02G476U.11.71.G05.1.454.CMB.2.raw
  modified_base (246)..(246): a, c, t, g, unknown or other
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacngcctctggcttcaccttcattacctatggcatgcacgtgggtccnccagacctccgaggcgagggggctgggaggtggggtggctagtttatttcatatgataggaaattgtgtacttctattcagtacctccggtagacggggtctattcccaccgtctccagacgacatcgacgcacacgctgtactctagacaaatgaactacgcctaggagagcgtaggaacggaccgacggtacgttaggttagttaacgttaccgtaggttacggaaaccggttaaaaggttaacttttaaccggttaaacgttaacgggtaaggggttacggtaacccggggtttaaccggggggttccgttttaaccggg

SEQ ID NO: 410097 - DNA, 550 bp, Homo sapiens
  misc_feature: GZ8MTXP02I5NM4.11.71.G05.1.454.CMB.2.raw
  modified_base (308)..(308): a, c, t, g, unknown or other
  modified_base (379)..(379): a, c, t, g, unknown or other
  modified_base (465)..(465): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagctctcctgtacagcctctggcttcaccttcattacctatggcatgccacgtcgggtcccnccagacctccgaggcgagggggctgggagtggggtgctagtttattcattatgataggaattgtgtacttntattcagtactccgtagacggccattccaccgtctccagacgacaacttccaggccacgacgtctgtatctagacaaatcgaaacngacctaggacgacgcgtaggacggacacgggtcttacgtagttaacttaacgtgtacgacgtaaagtactttacgtaagttaagg

SEQ ID NO: 410098 - DNA, 637 bp, Homo sapiens
  misc_feature: GZ8MTXP02GHU67.11.71.G05.1.454.CMB.2.raw
  modified_base (260)..(260): a, c, t, g, unknown or other
  modified_base (310)..(310): a, c, t, g, unknown or other
  modified_base (342)..(342): a, c, t, g, unknown or other
  modified_base (350)..(350): a, c, t, g, unknown or other
  modified_base (356)..(356): a, c, t, g, unknown or other
  modified_base (376)..(376): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggacgtccctgagactctcctgtacngcctctggcttcaccttcacttacctatcggcatcgctacgtcgggtccnccagcctccgaggcgaggggctgggagtgggngctagttnttcatntgataggaaatgtgtacttntattcagtacctccggtaggaacgggtccgtacttccgacccgttctacccgaggaacgaactaacgttacccgaagggccaacgaccgtcttagtacttcgtagaacctaaaagtcgaaaaccgagtacccgtaggacgtacgtacgtaggaacggaccgacggtcgttacggttagttactttacggtagtacggtaacggtaaaagttcgtttaacgtacgttaagggtacgggttacgaccggggtttaaccggggg

SEQ ID NO: 410099 - DNA, 603 bp, Homo sapiens
  misc_feature: GZ8MTXP02I2ZWM.11.71.G05.1.454.CMB.2.raw
  modified_base (244)..(244): a, c, t, g, unknown or other
  modified_base (249)..(249): a, c, t, g, unknown or other
  modified_base (293)..(293): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacngcctntggccttcacctttcattaccctatggcatgcacgtgggtcccnccagacctccgaggcgagggggctgggaggtggggtcgctagtttatttcatatgataggaaattgtgtactttctattcagtacctccggtgaacgggtccattccaccgtctaccagacgactaacttccgagcacacgctgtactctagactaaatcgaaacacgccgtaggaacgcggtaccgtagggaacggacgtaacggtcgttaggttacgttacgttacgttaggttacggaaacgtaaaggttactttaacgtaagttaggacgggttcgaaccgggttacgggggttacttttaccggg

SEQ ID NO: 410100 - DNA, 626 bp, Homo sapiens
  misc_feature: GZ8MTXP02H1763.11.71.G05.1.454.CMB.2.raw
  modified_base (248)..(248): a, c, t, g, unknown or other
  modified_base (253)..(253): a, c, t, g, unknown or other
  modified_base (264)..(264): a, c, t, g, unknown or other
  modified_base (292)..(292): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagccgtgggacgtcctgagactctcctgtacngcctngcttcaccttnattaccagtgcatgctacgtcgggcccncagcctccgaggcgagggggctggggaggtgggtgacttagtttattcgaatatgagtaggaaaattggtactactttctaattcgaagtaccgttccggtaggaaacgggtccctatttacccgtaccgtactacccgaagacgaactaacgttacccgaacggacctacgacgtcgtacgtactctacgaactaaaacgtacgaaaccgacgaccgtaggaagacgacgtaggacgtacgacggtctagttgttaattacgtagtacgtaacgtaaagttatttaacgtaagtaacggtagggtacgtaccggggtttacgggtactttacg

SEQ ID NO: 410101 - DNA, 604 bp, Homo sapiens
  misc_feature: GZ8MTXP02H1P94.11.71.G05.1.454.CMB.2.raw
  modified_base (254)..(254): a, c, t, g, unknown or other
  modified_base (295)..(295): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagcctggggaggtccctgagactctcctgtacagcctntggcttcaccttcattacctatggcatgcacgtgggtcccnccagacctccgaggccgagggggctgggaggtggggtggctaggttatttcaatagtgaacgtagggaaaaattggtagtactttcgtaattcaaggtactccggtagaaacggggtcccaaatttcccacccgtcctaccaagaacaacaaacttccgaaggccaacaaccgtctagtatctagactaaaatcgaaacagcctaggagagcgtaggaggacgacggtctaggtatattacgtgtacgacgtaaaagtatttaacgtaagtaacggtaggtacggtacggttaacgggggtctttacgg

SEQ ID NO: 410102 - DNA, 606 bp, Homo sapiens
  misc_feature: GZ8MTXP02HEF9Y.11.71.G05.1.454.CMB.2.raw
  modified_base (372)..(372): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggacgtccctgagactctcctgtacagcctctggcttcaccttcattacctatcggcatgcacgtcgggtccccagacctccgaggcgaggggctgggagtgggtgctagttattcatagtgataggaaatgtgacttntattcacgtactccgtaggaaacggccgtattccgacccgttcaccgaagacgaactaaacttccgaaggaccaacgacgtctaggtactcgtagactaaaagtagaaacaacgcctaggaacgacgacgtaggacggaaccgacgggccttaggttagtaacgtttaccgtaggtacgaacgtaaaagttactttacgtaagtaggtagggtacgtaacggtttaaccggggg

SEQ ID NO: 410103 - DNA, 642 bp, Homo sapiens
  misc_feature: GZ8MTXP02H43J8.11.71.G05.1.454.CMB.2.raw
  modified_base (261)..(261): a, c, t, g, unknown or other
  modified_base (274)..(274): a, c, t, g, unknown or other
  modified_base (279)..(279): a, c, t, g, unknown or other
  modified_base (305)..(305): a, c, t, g, unknown or other
  modified_base (377)..(377): a, c, t, g, unknown or other
  modified_base (592)..(592): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcggtgggggaggcggtggtccaggccgtgggagtccctgagactctctgtacngcctctggcttcnccttnattaccatgcatgcacgtcgggtccnccagacctccgaggcgaggggtctgggaggtgggtggctaagtttattcatatgtatggaaatgtgactttntattcagtaccgtcgtaggaaacggtcccgtatccaccgttctacgagaacgtactaacttaccgacggtaccacgtacgcttagtactcgttagacctaaaagtacggaaaacacgtacccgttaggacggaagtccgtaagggaacgggaccgtaacggggtccgttaggttacgttaaacgtttaccgtagggttacggaacgtaaaagttnttttaacgtacgttaaggtaaccgggttaggtaaaccgggtttacggggg

SEQ ID NO: 410104 - DNA, 628 bp, Homo sapiens
  misc_feature: GZ8MTXP02G580V.11.71.G05.1.454.CMB.2.raw
  modified_base (166)..(166): a, c, t, g, unknown or other
  modified_base (308)..(308): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcgtgggttttccncgttgctctttaagaggtgtccagtgtcaggtgcaactggaggagtcgtgggggagcgtggtccagccgtgggaggtccctgagactctcctgtacagcctctggcttcaccttcattacctatggcatgcacgtgggtccnccagactccgaggcgagggggtctgggagtggggtggtctaggtttatttcatagtgaatggaatgtgtacttctattacagtaccgtccgtaggaaacgggtccgtacgttccaacccgttctaccccgagaaccggtaaacctaaacgttcccgaacggacctaaccggaaccggtccttaaggtcttaccgtaacgaactaaacgtacgaaactacgtaccgtagaacgacggtacgtaggaacggacggtacggtacgtacgttacgttacttaacgtaggtaacgtaacgtaaacgttactttacgtaagtaagg

SEQ ID NO: 410105 - DNA, 567 bp, Homo sapiens
  misc_feature: GZ8MTXP02HTEWR.11.71.G05.1.454.CMB.2.raw
  modified_base (253)..(253): a, c, t, g, unknown or other
  modified_base (294)..(294): a, c, t, g, unknown or other
  modified_base (355)..(355): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagcctgggacgtccctgagactctcctgtacagcctntggcttcaccttcattacctatggcatgcacgtcgggtccnccagacctccgaggcgagggggctggagtgggtgctagttattcatatgataggaaatgtntacttctattcagactcgtagaacgggtcattccaccgtctaccagacgactaacttccacggaccacgacgtcgtagtatctagactaaaagtcgaaacgagacctaggaacgagcgaggacggacgacggtcttgttagtaacttacgtagtacgaacgtaaagtattaacgtagtaacggtaggtacgtacggtacgggggtctttacg

SEQ ID NO: 410106 - DNA, 559 bp, Homo sapiens
  misc_feature: GZ8MTXP02JZIV1.11.71.G05.1.454.CMB.2.raw
  modified_base (245)..(245): a, c, t, g, unknown or other
  modified_base (290)..(290): a, c, t, g, unknown or other
  modified_base (316)..(316): a, c, t, g, unknown or other
  modified_base (337)..(337): a, c, t, g, unknown or other
  modified_base (350)..(350): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagctctcctgtacngcctctggcttcaccttcattaccatggcatgcacgtgggtcccncagacctccgaggcgaggggctgggngtggggtgctagttattcatntgataggaatgtntacttctatcagtactccggtagaacgggctatccaccgtcctaccagacgactactccgagcacacgctagtatctagactaaatacgaacagcctagacgagcgtaggacggacgacggtcgtagtacgtagttacgtggtacgtaacgtaaagtatttaacgtaagtacggtagggtacggtacggttaccgggggtcgtttacgg

SEQ ID NO: 410107 - DNA, 576 bp, Homo sapiens
  misc_feature: GZ8MTXP02GOO82.11.71.G05.1.454.CMB.2.raw
  modified_base (249)..(249): a, c, t, g, unknown or other
  modified_base (254)..(254): a, c, t, g, unknown or other
  modified_base (295)..(295): a, c, t, g, unknown or other
  modified_base (444)..(444): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccaggccgtgggaggtccctgagactctcctgtacngcctntggcttcaccttcattacctatggcatgcacgtgggtcccnccagcctccgaggcgaggggctgggagtgggtgctagtttattcatagtgagtaggaatgtgtacttctattcagtactcggagaacgggcctattcccaccgtctaccgagacgactaacttccgagtcacgtacgctagtatcgtanaactaatacgaaacagccgtagagtagacgtaggacggacgacggtacgtaggttagttacgttacgtggtacgtaacgtaaagttactttgtaagtacggtaggtacggtacggtacgggggtactttacg

SEQ ID NO: 410108 - DNA, 525 bp, Homo sapiens
  misc_feature: GZ8MTXP02JAWYW.11.71.G05.1.454.CMB.2.raw
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcactgggtccgccagacctccgaggccgagggggctgggagtgggtggcagttattcatatgatggaatgtgacttctattcagtactcgtgaaggccattcaccgtctcccagacgacattcaggcacacgctgtatctgacaaatgaaactagcctagagagctaggacggacaacggctacgtgtaacttaacgtgtacgacgaaaagtactttactaagttaagg

SEQ ID NO: 410109 - DNA, 575 bp, Homo sapiens
  misc_feature: GZ8MTXP02HXFFD.11.71.G05.1.454.CMB.2.raw
  modified_base (273)..(273): a, c, t, g, unknown or other
  modified_base (313)..(313): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggaggcgtggtccagccgtgggacggtccctgagactctcctgtacagcctntggccttcaccttcattaccagtggcatgcacgtcggccncagacctccgaggcgagggggctgggagtggggtgctaggtttattcatagtgagtagggaattgtgtacttctattacagtacctcgtaggaaacggcctattccgaccgtctaccgagacgaactacttccgaggccacgacgtctagtactcctagacaaagtacgaaacacgtaccagaagacgacgaggacgacgaccggtacgtagttacggttattaacgtgtacggaacgtaaagtactttacgtaagtaaggg

SEQ ID NO: 410110 - DNA, 595 bp, Homo sapiens
  misc_feature: GZ8MTXP02I0F98.11.71.G05.1.454.CMB.2.raw
  modified_base (290)..(290): a, c, t, g, unknown or other
  modified_base (534)..(534): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgacgactctcctgtacagcctctgcttcaccttcattaccatggcatgcacgtgggtcccnccagacctccgaggcgagggggctgggaggtgggtggctagtttattcatatgaagtggaaaatgtagtacttctatcacgtactccgtagaacgggcctattccaccgtctccagagacactcgacggcacacgtctgtactcgtagactaaagtacgaacacgaccgtaggacgagtaccgtaggaacggaccgacggttcgttaggttattaacgttacgtaggtacgaacggtaaagttntttaacgtaagttaagggtaacgggttacggtacccgggttacgggggttacgttttacgg

SEQ ID NO: 410111 - DNA, 593 bp, Homo sapiens
  misc_feature: GZ8MTXP02IBAYV.11.71.G05.1.454.CMB.2.raw
  modified_base (288)..(288): a, c, t, g, unknown or other
  modified_base (342)..(342): a, c, t, g, unknown or other
  modified_base (347)..(347): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggagagtcgtgggggagcgtggtccagcctgggagtccctgagactctcctgtacagcctctggcttcaccttcattacctatggcatgcacgtgggtccncagctcgagacgaggggctggagtgggtgctagttattcatatgatggaaatgnacttnattccagtctccgtaggaacggtcctattccaaccgttcctacccgagaacgacgaaacttcgaaggaccaacgacgcctagtacttcctaggactaaaagtcgaaaccagacccgtaggaacgacggtcgaggaacgggacgaacgggtctagggttagtaaactttaccgtgttacgaaccgtaaaagttatttaaccgtaagtacgttaagggtacgtaccggttacgggggtactttaccgg

SEQ ID NO: 410112 - DNA, 540 bp, Homo sapiens
  misc_feature: GZ8MTXP02J2NTV.11.71.G05.1.454.CMB.2.raw
  modified_base (255)..(255): a, c, t, g, unknown or other
  modified_base (260)..(260): a, c, t, g, unknown or other
  modified_base (299)..(299): a, c, t, g, unknown or other
  modified_base (363)..(363): a, c, t, g, unknown or other
  modified_base (443)..(443): a, c, t, g, unknown or other
  modified_base (484)..(484): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggagtccctgagactctcctgtacngcctntggcttcaccttcattacctatggcatgcacgtggtccnccagactccgaggcgaggggctggagtgggtgcagttattcatatgataggaaatgtgtacttnattcagacgtccgtagaacgggccaattccacgtctccagagacatccagcacacgctgtactctagacaaagtgaaacncggtaccaggagagcgtaggaacggacgacgggctacggtnttaatacgtgtagaccgtaaagtcttacgtagttacggagtcgtacgttacggggg

SEQ ID NO: 410113 - DNA, 565 bp, Homo sapiens
  misc_feature: GZ8MTXP02JACTU.11.71.G05.1.454.CMB.2.raw
  modified_base (292)..(292): a, c, t, g, unknown or other
  modified_base (359)..(359): a, c, t, g, unknown or other
  modified_base (365)..(365): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccaggcctggggaggtccctgagactctcctgtacagcctctggcttcacttcattaccatggcatgcacgtgggtccnccagacctccgaggcgagggggctgggagtggggtggctagtttattcatagtgataggaaatggtntacttntattcagtactccgtagaacgggcctaattccaccgtctaccaagacgactaactccgacggacacgacgtctagtactcgtagacaaatacgaacacgcctagagagctagagacgacggtctgtagtattacgtgtagtaacgtaagtatttaacgtaagtacggtaggtacggtaccggtacggggtcgtttaacgg

SEQ ID NO: 410114 - DNA, 561 bp, Homo sapiens
  misc_feature: GZ8MTXP02J1M69.11.71.G05.1.454.CMB.2.raw
  modified_base (293)..(293): a, c, t, g, unknown or other
  modified_base (325)..(325): a, c, t, g, unknown or other
  modified_base (353)..(353): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcacgtcgggtcccncagactccgaggcgaggggctgggaggtgggngctagttattcatatgataggaaatgtntacttctattcagtacctccggtagaacggggcctattccgaccgtctaccagacgactaactccaggccacgacgtctgtatctagacaaatgaacagcctaggagacggcgtaggacggaacgacgggtctaggtagtactttacgtgtcgaacgtaaagttatttaagtagtaggtagggtacgacggtacgggggtctttacgg

SEQ ID NO: 410115 - DNA, 582 bp, Homo sapiens
  misc_feature: GZ8MTXP02GSTMQ.11.71.G05.1.454.CMB.2.raw
  modified_base (258)..(258): a, c, t, g, unknown or other
  modified_base (306)..(306): a, c, t, g, unknown or other
  modified_base (346)..(346): a, c, t, g, unknown or other
  modified_base (366)..(366): a, c, t, g, unknown or other
  modified_base (371)..(371): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggacgtccctgagactctcctgtacngcctctggcttcaccttcattacctatcggcatgctacgtgggtcccnccagacctccgaggcgaggggctggagtgggtgctagttnttcatagtgatagaaatgtnacttntattcagtacctcgtagaacggctatcaccgtctacagagacactccgagcacgcgtctgtactctagacaaagtacgaaacgacgtccgagaacgagcgtaggaacggtaccgacgggtcttacggttagttaacgtttacgaggttaacgacgtaaaaggttactttacgtaaggttaacggtaggtacgggtaacggtttaccggggg

SEQ ID NO: 410116 - DNA, 577 bp, Homo sapiens
  misc_feature: GZ8MTXP02GNG3V.11.71.G05.1.454.CMB.2.raw
  modified_base (294)..(294): a, c, t, g, unknown or other
  modified_base (331)..(331): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctctttaagaggtgtccagtgtcaggtgcaactggaggagtcgtgggggaggcgtggtccaggccgtgggaggtccctggagactctcctgtacagcctctggcttcaccttcattacctatggcatgcacgtgggtcccncagactcgaggcgaggggctggagtgggtgctagttnttcatatgatagaaattgtgtacttcttatcagtactccggtagaacggggcctatcccaccgtctaccgagacgacaattccgaggtcacgtacgctacgtactcgtagactaagtacgaaacagtaccgtaggagacgacgtggaacggacgacgggtctaggtagttacttacgtggtacgtacggtaaagttacttaacgtaatacgggtaggttacggaaccggtcgggggtactttacgg

SEQ ID NO: 410117 - DNA, 547 bp, Homo sapiens
  misc_feature: GZ8MTXP02HKMHT.11.71.G05.1.454.CMB.2.raw
  modified_base (264)..(264): a, c, t, g, unknown or other
  modified_base (310)..(310): a, c, t, g, unknown or other
  modified_base (372)..(372): a, c, t, g, unknown or other
  modified_base (379)..(379): a, c, t, g, unknown or other
  modified_base (431)..(431): a, c, t, g, unknown or other
  modified_base (435)..(435): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggacgtccctgagctctctgtacngcctctggcttcaccttcattacctatggcatgcacgtgggtcccncagctccgaggcgaggggctgggagtggggtgctagtttattcatagtgaagtggaattgtntactttntattcaagtcctcgtagacggcgatcgccgtctccagacgacactcagcacncgtngtatctagacaaagtcaacagcctagaagacgtcgtaggacgaacgacgggtctggttagttaacgttaacgtaggtacgtacgtaaaagttactttacgttaagtaacggg

SEQ ID NO: 410118 - DNA, 583 bp, Homo sapiens
  misc_feature: GZ8MTXP02F3TRU.11.71.G05.1.454.CMB.2.raw
  modified_base (314)..(314): a, c, t, g, unknown or other
  modified_base (380)..(380): a, c, t, g, unknown or other
  modified_base (476)..(476): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggaggcgtggtccaggccgtggggacgtccctgacgactctcctgtacagcctctggcttcaccttcattacctatggcatgcacgtgggtccnccagacctccgaggcgaggggctgggaggtgggtggctagtttatttcatatgattagggaattgngtacttctaattcagacctccgtagacggccgtattcaccgtctcccgagacgactaattccaggacacgacgctgtatctagacaaatcgaaacncgccgtagaggaagccgtaggaacggtacgaacgggtcttaggtacgttaacgttaaccgttggtaacgtaccggtaaaagttaccgttttaactagttaaacgggg

SEQ ID NO: 410119 - DNA, 541 bp, Homo sapiens
  misc_feature: GZ8MTXP02JS586.11.71.G05.1.454.CMB.2.raw
  modified_base (301)..(301): a, c, t, g, unknown or other
  modified_base (509)..(509): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggagtccctgagactctcctgtacagcctctggcttcaccttcattacctatggcatgcacgtgggtcccnccagacctccgaggcgagggggctgggagtggggtgctagttattcatatgataggaaatgtgacttctattcagtactccgtagaaacgggccgtattccgaccgtctccagacgacacttcaggcacacgctgtatctagacaatcgaacagcctagagagctagacggacacggtctggtattactacgtgtacgacgtaaagtntttacgagtaggaggtacggacgttacggggg

SEQ ID NO: 410120 - DNA, 580 bp, Homo sapiens
  misc_feature: GZ8MTXP02G9P2L.11.71.G05.1.454.CMB.2.raw
  modified_base (264)..(264): a, c, t, g, unknown or other
  modified_base (311)..(311): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagcctggggagtccctgagactctcctgtacngcctctggccttcaccttcattacctatcggcatgcacgtgggcccncagactccgaggcgagggggctgggagtggggtgctagtttattcatagtgattagggaattgtgtactttctaattcaagtcctcgtagaaacgggtcctacgttccaacccgttcctaccgagtaacgaacctaagttcccgaaggccaacgacgtctagtactctagaacaaatcgaaaccagtacctagagacgcgtaggacggacgacggtctagtacgttataacgtggtaacgaacggtaaagttactttacgtaagtaggg

SEQ ID NO: 410121 - DNA, 508 bp, Homo sapiens
  misc_feature: GZ8MTXP02GIA41.11.71.G05.1.454.CMB.2.raw
  modified_base (306)..(306): a, c, t, g, unknown or other
  modified_base (443)..(443): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccnccagactccaggcaggggctgggagtggggtgcagttattcatatgatggaatgtgacttctattcagtactccgtgaaggccgatcaccgtctccagacgacattccaggcacacgctgtatctgacaaatgaacngcctgacgagctagacggacacggctagtgtattaacgtgtcgacgaaagtctttactagtaagg

SEQ ID NO: 410122 - DNA, 532 bp, Homo sapiens
  misc_feature: GZ8MTXP02IHM4S.11.71.G05.1.454.CMB.2.raw
  modified_base (305)..(305): a, c, t, g, unknown or other
  modified_base (412)..(412): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggagcgtggtccagcctgggagtccctgagactctcctgtacagcctctggcttcaccttcattacctatggcatgcacgtgggtccnccagacctccgaggcgagggggctgggaggtggggtggctagtttattcatatgatagggaatgtgacttctattcagtactcgtgaggcgatcaccgtctccaganacaatccgagcacacgctgtatctagacaaatgaacagcctagaagacgcgtaggaacggacacgggtctacgttagtaattaacgtgtacgacgtaaaagtactttacgtaagtaaggg

SEQ ID NO: 410123 - DNA, 568 bp, Homo sapiens
  misc_feature: GZ8MTXP02HBBPM.11.71.G05.1.454.CMB.2.raw
  modified_base (292)..(292): a, c, t, g, unknown or other
  modified_base (354)..(354): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggaggtccctgagactctcctgtacagcctctggcttcaccttcattacctatggcatgcacgtgggtccnccagactccgaggcgagggggctgggagtggggtgctagttattcatatgataggaaatgtnactttctattcagtactccggtagaacggggccattccaccgtctaccagagacaattccagcacacgctgtatctagactaaatcgaacacgaccgtagacgagacgtaggaacggacgacggtctggtagttacgttacgtggtacgacgtaaagttacgtttaacgtaagtacggtaggtacggtaaccggttacgggggtacgtttacgg

SEQ ID NO: 410124 - DNA, 554 bp, Homo sapiens
  misc_feature: GZ8MTXP02J2I6D.11.71.G05.1.454.CMB.2.raw
  modified_base (364)..(364): a, c, t, g, unknown or other
  modified_base (398)..(398): a, c, t, g, unknown or other
  modified_base (426)..(426): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcacgtcgggtccgccaggacctccgaggcgagggggctggggaggtggggtggctagttattcatatgatggaaatgtgtacttntattcagtactcgtagagggcctatccaccgtcnccagagacatcaggcacacgctgtactntagacaaatacgaacacgacctggaagcgctaggacggacgacggtctggtacgtattacgtggtacgaacgtaaagtactttaacgtaagtacggagggttaggtaccggtacgggggtctttacgg

SEQ ID NO: 410125 - DNA, 598 bp, Homo sapiens
  misc_feature: GZ8MTXP02JLE1C.11.71.G05.1.454.CMB.2.raw
  modified_base (182)..(182): a, c, t, g, unknown or other
  modified_base (307)..(307): a, c, t, g, unknown or other
  modified_base (345)..(345): a, c, t, g, unknown or other
  modified_base (370)..(370): a, c, t, g, unknown or other
  modified_base (530)..(530): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgtttgcttcttttaagaggtntccagtgtcaggtgcaacgtggaggagtcgtgggggagcgtggtccagccgtggggacgtccctgacgactctcctgtacagcctgtggcttcaccttcattacctatggcatgcactcgggccncagacctcgaggcgaggggctggagtgggtgctagttntcatatgatagaaattgagtacttntattcgaacgtactccggtaggaaacggtccgtaacttccgtacccgtctaccgaagtacgtaactacgttaccgaacggaccaaccgacgtacttacggtactcgtagacctaaagtagaaactacgccgtaggacgagacgtaggaacgacgacggtntaggtagtacttacgtggtacgaacgtaaagtctttacgacgtaggtacggtacggacggttacgggg

SEQ ID NO: 410126 - DNA, 587 bp, Homo sapiens
  misc_feature: GZ8MTXP02F2U4O.11.71.G05.1.454.CMB.2.raw
  modified_base (248)..(248): a, c, t, g, unknown or other
  modified_base (297)..(297): a, c, t, g, unknown or other
  modified_base (438)..(438): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggacggtccctgagactctcctgtacngcctctggcttcacccttcattacctatggcatcgcacgtcgggtcccnccagacctccgaggcgagggggctgggagtggggtggctagtttatttcatagtgagtaggaaatgtgtactttctaattcagacctcggtagaacggggtcctattccaccgtctccgagagactaatccgagcacgacnctagtactctagacaaatcgaaactacgccgtagagacgcgtaggaggaccgacggtctagttagttaattacgtaggtacgtaacggtaaaagttactttaacgttaagtaagggtacggtaggtaccggttacgggggtctttacgg

SEQ ID NO: 410127 - DNA, 589 bp, Homo sapiens
  misc_feature: GZ8MTXP02JMJUO.11.71.G05.1.454.CMB.2.raw
  modified_base (291)..(291): a, c, t, g, unknown or other
  modified_base (365)..(365): a, c, t, g, unknown or other
  modified_base (542)..(542): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcacgtgggtccnccagacctccgaggcgagggggctgggaggtgggtggctaggtttattcatatgagtaggaaatagtgtacttntattcagtactccggtagaaggggcccgtaattccacccgttctacccgaagacgactaacgttccgacggaccaccgacgctagtactcctagacctaaatcgaaaccagccgtaggacgacgcgtaggaacgacgacggtcttaggtgtaacttacgtaggtacgacgtaaagtntttaacgtagtaaggagggtcgaaccgggtacgggggtactttacgg

SEQ ID NO: 410128 - DNA, 588 bp, Homo sapiens
  misc_feature: GZ8MTXP02HA62X.11.71.G05.1.454.CMB.2.raw
  modified_base (295)..(295): a, c, t, g, unknown or other
  modified_base (460)..(460): a, c, t, g, unknown or other
  modified_base (471)..(471): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggaggtccctgagactctcctgtacagcctctggtcttcaccttcattacctatggcatcgcacgtcgggtccnccagactccgaggcgaggggctgggagtggggtgctagtttattcgatatgataggaaatgtgtacttctattcagtactccggtagaacggggtcctatccaccgtctaccgagacgactaactccgaggcctacacgtactgtactctagacaaagtgaaacncgcctagacgngcgtaggacgacgacggtctaggttacgttaacgttacgtaggtacggtaacgtaaagtttactttaacgtaagtaagggtacggttacggtaaccgggttacgggggtcgtttcgg

SEQ ID NO: 410129 - DNA, 635 bp, Homo sapiens
  misc_feature: GZ8MTXP02GMW3H.11.71.G05.1.454.CMB.2.raw
  modified_base (251)..(251): a, c, t, g, unknown or other
  modified_base (322)..(322): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctntggcttcaccttcattaccctatggcatgcactgggtccgccagactccgaggcgaggggctggagtgggngctagttattcatatgatggaaatgtgacttctattccagactccggtagaaacggggcctaattccaacccgtctacccgagaacgaactaaacgttacccgaacgggacaaccgaaccggtcctaggttaaactccgttagaacaaaagttacgaaaacgacgtacccgaggaagacggactaggacggaaaccgaaccgggtacgttggttaggtttaatttaccgtacggttacgaaccgtaaaaggttaatttaacgtaaagttaacggaacggttggtaaaccgggtacgggggtacgttttaccgg

SEQ ID NO: 410130 - DNA, 595 bp, Homo sapiens
  misc_feature: GZ8MTXP02I2FN9.11.71.G05.1.454.CMB.2.raw
  modified_base (295)..(295): a, c, t, g, unknown or other
  modified_base (330)..(330): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagcctgggagtccctgagactctctgtacagcctcgtcggtcttcaccttcattacctatggcatgctacgtgggtcccnccagacctccgaggcgaggggctgggagtgggtgntagtttattcatatgactaggaaatgtgtacttactattcgagtacctccggtagaaacggggcctaattccgacccgtctaccgagaacgaactaacgttaccgacggcaaccgacgtctacgttaactcctagaactaaagtacgaacacgacctaggaagacgacgtacggaacggacgacggtcgtagttacgttagttacgtagtacgaacgtaaagtacttaagtagtaggacggtacgaacggtacggggtctttacg

SEQ ID NO: 410131 - DNA, 701 bp, Homo sapiens
  misc_feature: GZ8MTXP02H96O7.11.71.G05.1.454.CMB.2.raw
  modified_base (267)..(267): a, c, t, g, unknown or other
  modified_base (311)..(311): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtcagcctgggagtccctgagactctcctgtacagccctntggccttcacccttcattaccctatggcatgcacgtgggtcccnccagctccgaggcgagggggctggagtggggtgctagttatttcgatagtgaagtgggtaatcggtatacctttctaattccgaataccctcccggttaggaaacgggtcccgtacgtttacccacccgtttacgtacccgaaagtacgtaaacctaaacgttacccgaaacgggtcctaaacccgaacggtcccttaggttaaccttaccgttacggtaaaccaaaaagttacggaaaacctaacggaccccgtaagggaaacggtaaacggccgttaaggggaaacggtaaacccggaaccgggtccgtttacggttacgtttaaagtttaaccgttcggtaaggtaaccggtaaaaagttaccgttttaacgttaaagtaaacgggg

SEQ ID NO: 410132 - DNA, 591 bp, Homo sapiens
  misc_feature: GZ8MTXP02GMJ5C.11.71.G05.1.454.CMB.2.raw
  modified_base (261)..(261): a, c, t, g, unknown or other
  modified_base (266)..(266): a, c, t, g, unknown or other
  modified_base (278)..(278): a, c, t, g, unknown or other
  modified_base (307)..(307): a, c, t, g, unknown or other
  modified_base (339)..(339): a, c, t, g, unknown or other
  modified_base (348)..(348): a, c, t, g, unknown or other
  modified_base (468)..(468): a, c, t, g, unknown or other
  modified_base (499)..(499): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactcctctgtacngcctnggcttcaccttnacttacctatcggcatgcacgtcgggccncagacctcgaggcgaggggctgggaggtgggngctagtttnttcaattatagataggaatggtactaactttctattacgacgtaccgtccgtagaacgggccgtattccgacccgttcaccgaagaacgaactaaacgttccgaaggaccaactacggtntaggttactcgacgaactaaagtacgaaacngaccgtagaagacgtcgtaaggacggaacgacggtacgttacgtagttaagttaacgtgaacggtaacgtaaaagttctttacaagtaaggg

SEQ ID NO: 410133 - DNA, 610 bp, Homo sapiens
  misc_feature: GZ8MTXP02JE04V.11.71.G05.1.454.CMB.2.raw
  modified_base (345)..(345): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagccctctggcttcaccttcattacctatggcatgcacgtgggtcccgccagacctccgaggccgagggggctgggagtgggngcagttattcatatgataggatgtgtacttctattacagtactccgtagaacggccgtattccaacccgtctacccgagtacgaactaacttccgaaggcccaacgaccgtcgttagtacttcgtagacctaaaagtcggaaaacacggacccgtaggaacggaacggcgtagggaacggacccgacgggttccgttaggttacgttaaacgttaaccgtaggtacggaacgttaaaaggtacttttacgtaaaggttaaacggg

SEQ ID NO: 410134 - DNA, 603 bp, Homo sapiens
  misc_feature: GZ8MTXP02GVDHA.11.71.G05.1.454.CMB.2.raw
  modified_base (247)..(247): a, c, t, g, unknown or other
  modified_base (295)..(295): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctggggaggtccctgagactctcctgtacngcctctggcttcaccttcattacctatggcatcgcacgtggggtcccnccagacctccgaggcgagggggctgggaggtgggtggctaggtttattcatatgagtaggaaactgtgtacttctattcgatacgtccgtaggaacggggtctaattcccgacccgtctaccgagacgaacaagttaccgacggacacgacgcctagtactctacgactaaagtacgtaacgacgaccgtaggaacgagtacgaggaacgggaccgacggtacgtaggtagttacgttacgtggtacgaacgtaaagttactttaagtagtaaggtaggtacggtaacggtacgggggtctttaccgg

SEQ ID NO: 410135 - DNA, 532 bp, Homo sapiens
  misc_feature: GZ8MTXP02GFNXI.11.71.G05.1.454.CMB.2.raw
  modified_base (290)..(290): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcactgggtccnccagactccaggcagggggctgggagtggggtggctagttatttcatatgataggaaatgtgacttctattcagactccgtgaacggggccattcaccgtctccagagacaattccaggcacacgctgtatctgactaaaatgaaacagacctgagagctagaggacacgggtctgtagtacttacgtgtacgacgtaaagtattaagtaagtaggtaggtagacggtacggggtcgttacg

SEQ ID NO: 410136 - DNA, 642 bp, Homo sapiens
  misc_feature: GZ8MTXP02JJX6B.11.71.G05.1.454.CMB.2.raw
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacagcctctggcttcaccttcattacctatggcatcgcacgtcgggtccnccagactccgaggcgaggggctggaggtgggtgctagttacttcatatgataggaaatgtgtacttacttattcgagtaccgttccggtaggaaacggggtcctaattcccgtacccgttacctaccgacgtaacgtaactaacgttaccacgggggaccaccgaccgtacgtacgttactacgtacgtactaaacgtacgaaaccgacgtaccgtagaacgagtacgtaggaacggtacgacggtaccgtaggttacgttaacgtttacgttacggtacgtaacggtaaggttaactttaacgtaagttacggtacggtacggtaaccggtacggggtacggtttaccgg

SEQ ID NO: 410137 - DNA, 582 bp, Homo sapiens
  misc_feature: GZ8MTXP02IFFYP.11.71.G05.1.454.CMB.2.raw
  modified_base (246)..(246): a, c, t, g, unknown or other
  modified_base (292)..(292): a, c, t, g, unknown or other
  modified_base (355)..(355): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggaggcgtggtccagccgtgggagtccctgagactctctgtacngcctctggcttcaccttcattacctatggcatgcacgtcgggtccnccagacctccgaggcgagggggctgggaggtgggtgctagttattcatatgataggaaatgtntactttctattcaagtactccgtagaacggggtccgattcccgaccgttcctacccgagacgaactaacgttccgaacggacaacacgactagtactctacgactaaaatacgaacacgccgtagagagcgtaggacggacgacggtctagttatacgttacgtgtacgtaacgtaagttacgttaagtagtaggtacggtacgtacgggtacgggtacgtttacgg

SEQ ID NO: 410138 - DNA, 552 bp, Homo sapiens
  misc_feature: GZ8MTXP02J39U5.11.71.G05.1.454.CMB.2.raw
  modified_base (250)..(250): a, c, t, g, unknown or other
  modified_base (285)..(285): a, c, t, g, unknown or other
  modified_base (344)..(344): a, c, t, g, unknown or other
  modified_base (438)..(438): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggagagtcgtgggggaggcgtggtccagcctgggagtccctgagactctcctgtacagcctntgccttcacttcattaccatgcatgcactgggccncagactccgaggcgaggggctggagtggtgctagtttattcatatgataggtaaatgtntactttctattcagactccggtgaacgggccattcccaccgtctaccagacgacaattccaggcacacgtctgtatctagacaaagtgaaaccncgcgtgagagtacgagacggacgtacggtctgttagttaacttacgtgtacgtacgtaaagttactttaacgtagtacggtacgggtacggtaccgggttacggggtcgtttcg

SEQ ID NO: 410139 - DNA, 612 bp, Homo sapiens
  misc_feature: GZ8MTXP02GK5NV.11.71.G05.1.454.CMB.2.raw
  modified_base (342)..(342): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggagtccctgagactctcctgtacagcctctggcttcaccttcattacctatggcatgcacgtcgggtccgccagcctccgaggcgagggggctgggagtgggngctagttatcatatgataggaatgtgtacttctattcaagtaccttccgtaggaaacggggtcctaagttcccgaacccgttcctacccgaagtaacggaacctaaacttcccgaagggacccaaccgtaccgtccgttagtaacgttcgtaacggaccaaaagttcggaaaacacgtaccgtaggaacgtagccgtaggaacggacgaacggggtctggtacgttacttaacgtggtacgaacgtaaagttactttactaagtaacggg

SEQ ID NO: 410140 - DNA, 609 bp, Homo sapiens
  misc_feature: GZ8MTXP02IBUII.11.71.G05.1.454.CMB.2.raw
  modified_base (249)..(249): a, c, t, g, unknown or other
  modified_base (263)..(263): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggtttttcctcgttgcttcttttaagaggtgtccagtgtcaggtgcaactgggaggagtcgtgggggagcgtggtccagccgtgggacgtccngagctctctgtacngcctctgcttcaccttcattacctatggcatgcctacgtcggtccgccagacctccgaggcgagggggctgggaggtgggtggctagtttattcatatgatagggtaatgtatactttattattcgacgtacgtccgtaggaaacgggtccgtacgttaccgacccgttcgtacccgaaggtaacgaaccttaaacgttaccgaacggaccaaccgacgtacgttacgttaactccgtagaactaaaattacgaaaccgaacgtccgtaggaagacgcgtaggaaacgacgacggtcgtggttacgttagtaacgtgtacgacggtaaaatctttactaagtaagg

SEQ ID NO: 410141 - DNA, 641 bp, Homo sapiens
  misc_feature: GZ8MTXP02HVSBB.11.71.G05.1.454.CMB.2.raw
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagcctgggaggtccctgagactctcctgtacagcctctggccttcaccttctacttacctatggcatgcacgtcgggtccgccagcctccgaggcgaggggctggaggtgggtgctagttattcatagtgataggaaatgtgtacttctattcagtacttccggagtaaccggggccgatttaccgacccgtctaccgtagacgactaaacttccgacggaccaacgaccggtcttacgtactccgttagaacctaaaagtcgaaacgcgtaccgtagaacggtaggaccgaggaaacgggtccaaccggggttcttaggttacgttaacgtttacgtaggtaacgtaaacggttaaagtttactttaacgtaaaggtaacgggtacgggtacggtaaccggggttacgggggtttacgtttcgg

SEQ ID NO: 410142 - DNA, 554 bp, Homo sapiens
  misc_feature: GZ8MTXP02HFRQ8.11.71.G05.1.454.CMB.2.raw
  modified_base (247)..(247): a, c, t, g, unknown or other
  modified_base (252)..(252): a, c, t, g, unknown or other
  modified_base (290)..(290): a, c, t, g, unknown or other
  modified_base (476)..(476): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtgggttttcctcgttgctcttttaagaggtgtccagtgtcaggtgcaactggaggagtcgtgggggaggcgtggtccagcctgggaggtccctgagactctcctgtacngcctntggcttcaccttcattaccatgcatgcacgtgggtccnccagactccgaggcagggggctggagtggggtgctagtttattcatatgataggaaaatgtgtacttctaattccgaagtaccttccggagaaacgggcctaatttccaacccgtctaccagaacgactaatccgaacggcacgaacgctgtaactcgtagactaaatagaacagcctagagacgngagagacgacgtctgtatactacgtgtacgactaagtagttaagtaagtaggacggtaggtacggtacgggtcttacg

SEQ ID NO: 410143 - DNA, 572 bp, Homo sapiens
  misc_feature: GZ8MTXP02HOI0L.11.71.G05.1.454.CMB.2.raw
  modified_base (299)..(299): a, c, t, g, unknown or other
  modified_base (365)..(365): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtgggttttcctcgttgcttcttttaagaggtgtccagtgtcaggtgcaactggaggagtcgtgggggaggcggtggtccagccgtggggaggtccctgagactctcctgtacagcctctggcttcaccttcattacctatggcatgcacgtcggggtcccnccagacctccgaggccgagggggctgggaggtggggtgcagtttattcatatgataggaaattgtntacttctattcagtactccggtgaacgggcgtattccaccgtctccagacgactaacttccgaggacacgacgctagtactctgacaaatacgaacacgcctagagagcgtaggacggacacggtcgttagtgttacgttacgtgtacgacgtaaagttacgtttaagtaagtaggtaggtacgtacggttacgggggtcgtttacg

SEQ ID NO: 410144 - DNA, 748 bp, Homo sapiens
  misc_feature: GZ8MTXP02G26GT.11.71.G05.1.454.CMB.2.raw
  modified_base (246)..(246): a, c, t, g, unknown or other
  modified_base (251)..(251): a, c, t, g, unknown or other
  modified_base (292)..(292): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacngcctntggcttcaccttcattacctatggcatgcacgtcgggtccnccagactccgaggcgagggggctgggaggtgggtgctagttattcatatgataggaaattgtgtactttctattcagtactccggtaggaacggggtcctaattcccgaacccgttctaccctaaggaacgaacctaaacgtttacccgaacgggaccaaccgaaccggtacttacggttaacttaccgttacggaaaccgtaaaagttacggaaaaccgtaacgggtaccccgttaagggaaacgggtacggaccggttagggaaaccggggaaccgtaaacccgggggttcctttaggggtttacggtttaaacgttttaaccggttacgggttaacgggtaaacccggttaaaaagtttacgttttaaaccgttaaacggtttaaaggggtaacgggggtttaacgggtaaacccgggggtttaaccgggggggtttccgtttttaacccggg

SEQ ID NO: 410145 - DNA, 633 bp, Homo sapiens
  misc_feature: GZ8MTXP02JTSFX.11.71.G05.1.454.CMB.2.raw
  modified_base (309)..(309): a, c, t, g, unknown or other
  modified_base (381)..(381): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccagcctgggaggtccctgagactctcctgtacagcctctggcttcaccttcattacctatggcatgcactgggtcccncagacctccgaggcgagggggctgggagtggggtggctagtttatttcgatatgaatgggaatgtgtacttntattcagtacctccgtagaacgggtccgtattccgaacccgtctacccgaagaacgaacctaaacgtttcccgaagggtccaaacgtaccgtacgtaggttactctacgaaccaaaagttcggaaacacgtcccgtaggaagtaacggccgtagggaaacgggaccgtaacgggtccgttaggttacggttaacgttaaccgttggtacggtaaccggtaaaagttacgtttaacgtaaggtttaaacgggg

SEQ ID NO: 410146 - DNA, 542 bp, Homo sapiens
  misc_feature: GZ8MTXP02FE3V3.11.71.G05.1.454.CMB.2.raw
  modified_base (258)..(258): a, c, t, g, unknown or other
  modified_base (298)..(298): a, c, t, g, unknown or other
tcagcgagagataccacgaccggtgctcgatttagtgtcgtcgcaagagagaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggagagtctgggggaggcgtggtccagccgtgggagtccctgagactctcctgtacagcctnggcttcaccttcattacctatggcatgcacgtgggtcccnccagacctccgaggcgagggggctgggaggtggggtgctagttatttcatatgataggaaatgtgacttcattcagactcgtagaacgggcatcaccgtctcagagacatcagcacacgctgtatctgacaaatgaaacacgcctagagagacgtagaacggacgacggctggtagttaattacgtaggtcgacggtaaaagtactttacgtaagtaggtagggtacgtacggttaaccggggg

SEQ ID NO: 410147 - DNA, 557 bp, Homo sapiens
  misc_feature: GZ8MTXP02GIXF3.11.71.G05.1.454.CMB.2.raw
  modified_base (306)..(306): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctggggagtccctgagactctcctgtacagcctctggcttcaccttcattacctatggcatgcacgtggtccncagactccgaggcgagggggctgggagtgggtggctagttattcatatgatggaatgtgtacttctattcagtactccgtgaacgggccgtattccacccgtctaccgagacgaactacttccgaggaccacgacgcttagtatctagacaaatcgaaacagcctagagacgcgtaggacggacgacggtctacggtattacgttaacgtggtacggtaacgtaaaaggttactttacgtaagttaagggg

SEQ ID NO: 410148 - DNA, 512 bp, Homo sapiens
  misc_feature: GZ8MTXP02I9B8X.11.71.G05.1.454.CMB.2.raw
  modified_base (304)..(304): a, c, t, g, unknown or other
  modified_base (360)..(360): a, c, t, g, unknown or other
  modified_base (399)..(399): a, c, t, g, unknown or other
  modified_base (438)..(438): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggagtccctgagctctcctgtacagcctctggcttcaccttcattacctatggcatgcactgggtccnccagactccgaggcaggggctgggagtgggtgcagttattcatatgatgggatgtnacttctatcagactcgtgaaggcgatcacgtctccaganacattccaggcacacgctgtatctagacaaagtgaaacngcctagagtacgctaggacggtacacggtctgtgtattaacgtgtacgacgtaaagtactttacgtagtaaggg

SEQ ID NO: 410149 - DNA, 586 bp, Homo sapiens
  misc_feature: GZ8MTXP02HL3YO.11.71.G05.1.454.CMB.2.raw
  modified_base (265)..(265): a, c, t, g, unknown or other
  modified_base (311)..(311): a, c, t, g, unknown or other
  modified_base (345)..(345): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagcctgggaggtccctgagactctcctgtacngcctctgcttcaccttcacttacctatggcatgcacgtcgggtccnccagacctccgaggcgagggggctgggagtgggngctagtttatttcatagtgagtaggaattgtatacttctatttcgaagtacctccgtaggaacggggcctacgtttccaacccgttctacccgaagtaacgaacaacttaccgaggaccacacgtctagtactactagaccaaagtcgaaacacgacctaggaagcgaccgtaggaacgacgacggtctacggttagtagttaacgtgtacgacggtaaaagttctttacgtaagtaaggg

SEQ ID NO: 410150 - DNA, 571 bp, Homo sapiens
  misc_feature: GZ8MTXP02JLKW7.11.71.G05.1.454.CMB.2.raw
  modified_base (243)..(243): a, c, t, g, unknown or other
  modified_base (287)..(287): a, c, t, g, unknown or other
  modified_base (498)..(498): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagctctcctgtacngcctctgcttcaccttcattacctatggcatgcacgtgggtccnccagacctccgaggcgagggggctgggaggtggggtgctagtttattcatatgagtaggaaatgtgtacttctattcagtactccggtagaacgggccgtattccgaccgtctaccgagacgactaactccgaggacacgacgtctgtactctagaacctaaagtacgaaacacgtcctagacgacgcgtaggacggacgcggtctaggtntacgttacgtaggtacgaacggtaatactttaagtaagtacggtagggtagaccgggtacggggtcgtttacg

SEQ ID NO: 410151 - DNA, 538 bp, Homo sapiens
  misc_feature: GZ8MTXP02JVA4D.11.71.G05.1.454.CMB.2.raw
  modified_base (263)..(263): a, c, t, g, unknown or other
  modified_base (268)..(268): a, c, t, g, unknown or other
  modified_base (278)..(278): a, c, t, g, unknown or other
  modified_base (285)..(285): a, c, t, g, unknown or other
  modified_base (305)..(305): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (362)..(362): a, c, t, g, unknown or other
  modified_base (368)..(368): a, c, t, g, unknown or other
  modified_base (442)..(442): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggagtccctgagctctcctgtacngcctntgctcacctnattaccntgcatgcacgtcgggtcccncagacctccgaggcgaggggctgggagtgggtgctagttnttnatngataggatgtntacttntattcagtacctccgtagacggcctattccaccgtctccgagacacactccgagcacgacgctagtactcgtanacctaaatacgaacacgctagacgacgcgaggaacggactacggtcgtagtacgttacttaacgtgtacgtacgtaaagttatttacgtagtaagg

SEQ ID NO: 410152 - DNA, 586 bp, Homo sapiens
  misc_feature: GZ8MTXP02HAAIS.11.71.G05.1.454.CMB.2.raw
  modified_base (246)..(246): a, c, t, g, unknown or other
  modified_base (291)..(291): a, c, t, g, unknown or other
  modified_base (360)..(360): a, c, t, g, unknown or other
  modified_base (366)..(366): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacngcctctggcttcaccttcattacctatggcatgcacgtgggtccnccagacctccgagggccgagggggctgggaggtggggtggctagtttattcatatgagtaggaaatgtntacttntattcagactccggtagaacggtctattccaccgtctccgaagacgtaactaacttaccgacggacaacgacgtctagtactcgtagacaaatacgaacacgcctagacgagcgtagaacggacgtaacggcgttagttagttacgttactggtacgtaacgtaaagtacgtttaagtaagtacggtagggtacggaccgggttacgggggtctttacgg

SEQ ID NO: 410153 - DNA, 556 bp, Homo sapiens
  misc_feature: GZ8MTXP02JWFJ3.11.71.G05.1.454.CMB.2.raw
  modified_base (260)..(260): a, c, t, g, unknown or other
  modified_base (307)..(307): a, c, t, g, unknown or other
  modified_base (376)..(376): a, c, t, g, unknown or other
  modified_base (502)..(502): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccaggccgtgggacgtccctgacgactctcctgtacngcctctggcttcaccttcattacctatggcatgcacgtggggtcccncagacctccgaggcgagggggctgggaggtggggtgctagtttattcatatgatggaaatgtgtacttntatcagactcgtgaacgggcctatcgaccgtctcagagacaatccaggcacacgactgtatctagacaaatagaacacgcctaggagacgctaggaacggacacgggctacggtgttactttacgngttacgacgtaaagtactttacgtagtagtacggtacggtaccggttacggggg

SEQ ID NO: 410154 - DNA, 547 bp, Homo sapiens
  misc_feature: GZ8MTXP02FVBC5.11.71.G05.1.454.CMB.2.raw
  modified_base (307)..(307): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacagcctctggcttcaccttcattacctatggcatgcacgtgggtcccnccagacctccgaggcgagggggctgggagtggggtgctagtttattcatatgataggaatgtgtacttctattcagtactccgtagaacggcctaattcacccgtctaccagacgacaattccgaggacacacgctagtactctagacaaatgaaacagacctagacgagcgtaggacggacgacggtcgttagtagtttactaacgtggtagaacgtaaagtactttacaagttaaggg

SEQ ID NO: 410155 - DNA, 609 bp, Homo sapiens
  misc_feature: GZ8MTXP02FV6KU.11.71.G05.1.454.CMB.2.raw
  modified_base (261)..(261): a, c, t, g, unknown or other
  modified_base (266)..(266): a, c, t, g, unknown or other
  modified_base (309)..(309): a, c, t, g, unknown or other
  modified_base (342)..(342): a, c, t, g, unknown or other
  modified_base (483)..(483): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggacggtccctgagacttctccgtgtacngcctntggcttcaccttcattacctatggcatgctacgtcgggtcccncagacctccgaggcgaggggctgggaggtgggngctagtttattcatatgagtaggaaattgtcgtactttctattcagtacctccggtagaacgggtccgtaattccgacccgtctaccgaagaacgtactaacttccgaaggccaacgacgtccgttagtacttaccgtaanaaactaaagtacgaacgacgtacgtagaagacgtacgaggaacgacgtacggtcttacgttagttacttacgtacgtagtaacgtaagttacttacgtaggtaggtacggtacggtacggtacggg

SEQ ID NO: 410156 - DNA, 640 bp, Homo sapiens
  misc_feature: GZ8MTXP02GMF2W.11.71.G05.1.454.CMB.2.raw
  modified_base (292)..(292): a, c, t, g, unknown or other
  modified_base (310)..(310): a, c, t, g, unknown or other
  modified_base (315)..(315): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtgggttttcctcgttagctcttttaagaggtgtccagtgtcaggtgcaactggaggagtctgggggagcgtggtccagcctgggagtccctgagactctcctgtacagcctctggcttcaccttcattaccctatggcatgcatggggtccccncagctcgaggcgaggggntgggnggtgggtgctagtttattcatagtgtagtaggtaaatgtactactttctattcacgtactcggtagacggtctattccgaccgtactaccgagacaactaacgtccgacgacacgacgtcgtagtactcgtagaactaaagtacgaaacgtacgaccgtaggacggtacgacgtacggaacgggaacggtaccggtacggttacggttacgttaacgtttaacgttacggttacggtaacggtaaaacgttaacgtttaacgttaacggttaacgggtaacgggttacgggtaaccggggttaccgggggttaccgggtttacgg

SEQ ID NO: 410157 - DNA, 546 bp, Homo sapiens
  misc_feature: GZ8MTXP02GY5VP.11.71.G05.1.454.CMB.2.raw
  modified_base (260)..(260): a, c, t, g, unknown or other
  modified_base (307)..(307): a, c, t, g, unknown or other
  modified_base (376)..(376): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggtcttcctcgttgctcttttaagaggtgtccagtgtcaggtgcaactggaggagtcgtgggggagcgtggtccagcctgggagtccctgagctctcctgtacngcctctggcttcaccttcattacctatggcatgcacgtcgggtcccnccagacctccgagggcgaggggctgggagtggggtgcctagttattcattatgatggaatgtgtacttntattcagtactcgtaggacggcgtacttccgaccgtctaccagacgactacttaccgagcacacgctagtactcgtagacaaagtacgaactacgaccgtagaagacgcgtaggaacggacgacggtcgtgtagttaagttacgtggtacgagtaagtactttactaagg

SEQ ID NO: 410158 - DNA, 585 bp, Homo sapiens
  misc_feature: GZ8MTXP02G8WGP.11.71.G05.1.454.CMB.2.raw
  modified_base (289)..(289): a, c, t, g, unknown or other
  modified_base (363)..(363): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctcctgtacagcctctggcttcaccttcattacctatggcatgcacgtgggccnccaggacctccgagggccgagggggctaggggagtggggtgctaggtttatttcatatggatagggaaatggtntactttctattcgagtaccgtccggtgaacggggcctaattccgaccgtctccgagacgacaattccgacggcacgacgctgtatctagactaaatagaacgagccgtagacgacgcgtaggacggacacggtcgtggttagttacgttacgtggtacgacggtaaagttagtttaacgtaagtacggtagggtacggtaccggttacgggggtctttacgg

SEQ ID NO: 410159 - DNA, 611 bp, Homo sapiens
  misc_feature: GZ8MTXP02GXTGT.11.71.G05.1.454.CMB.2.raw
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcacgtgggtccnccagacctccgaggcgaggggctgggagtggggtgctagtttattcatatgaagtaggaaaacttggtagtactttctaattccgaacgtacttccggtagaacggggtccgtatttcccaccgtctacccgaagacgaactaacgttacgacggcacgacgtcgtagtactctagactaaagtcgaaactagaccgtaggagagcgtaggaacggacgacggtcgtaggttagttacgttacgtaggtacggtaacgtaaagttacgttaacgtaagtacggtacgggtacggtaccgggtacgggggtacgtttacgg

SEQ ID NO: 410160 - DNA, 512 bp, Homo sapiens
  misc_feature: GZ8MTXP02H4878.11.71.G05.1.454.CMB.2.raw
  modified_base (271)..(271): a, c, t, g, unknown or other
  modified_base (296)..(296): a, c, t, g, unknown or other
  modified_base (342)..(342): a, c, t, g, unknown or other
  modified_base (352)..(352): a, c, t, g, unknown or other
  modified_base (391)..(391): a, c, t, g, unknown or other
  modified_base (418)..(418): a, c, t, g, unknown or other
  modified_base (420)..(420): a, c, t, g, unknown or other
  modified_base (423)..(423): a, c, t, g, unknown or other
  modified_base (425)..(425): a, c, t, g, unknown or other
  modified_base (427)..(427): a, c, t, g, unknown or other
  modified_base (429)..(429): a, c, t, g, unknown or other
tcagcgagagataccacgaccggtgctcgatttagtgtcgtcgcaagagagaggggggagaggagcccagcactagaagtcggcggtgtttccattcggtgatcagcactgaacacagaggactcaccatggagtttgggctgagcttgggtttttcctcgttgcttcttttaagaggtgtccagtgtcaggtgcaactggaggagtcgtggggagcgtggtccagcctgggagtccctgagactctctgtacagcctctggctcaccttnattaccatggcatgcacgtggtccnccagcctccaggcgaggggctggagtgggtggctagttattcatangatgaaatgngacttcattcagtctcgtggaagcgattcacgtctcagngacaattcagctacacgctgtatctananaananananacagagagagagacgacgacgcgtacgtagtacgtacgtacgtagagtaagtacgttactagtagtaggtacgtacggtacgg

SEQ ID NO: 410161 - DNA, 594 bp, Homo sapiens
  misc_feature: GZ8MTXP02GWMYZ.11.71.G05.1.454.CMB.2.raw
  modified_base (262)..(262): a, c, t, g, unknown or other
  modified_base (302)..(302): a, c, t, g, unknown or other
  modified_base (473)..(473): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggagcgtggtccagccgtgggacgtccctgagactctcctgtacagcctntggcttcaccttcattacctatggcatgcacgtgggtccnccagacctccgaggcgagggggctgggagtggggtgctagtttattcatatgataggaaattgtgtactttctattcagtacctcggtagaaacgggtcctattccgaccgtctaccgagacgaacaattccgaggccacacgctgtactctagacctaaagtcgaaaccngaccgtagaacgagcgtaggaacggacgtaccgggcttaggttacgtaatttacgtaggtacgaacgtaaaagttcgtttaacgtagtaacggtacggtacggtaaccggtttaacggggg

SEQ ID NO: 410162 - DNA, 549 bp, Homo sapiens
  misc_feature: GZ8MTXP02G42X2.11.71.G05.1.454.CMB.2.raw
  modified_base (309)..(309): a, c, t, g, unknown or other
  modified_base (477)..(477): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggagcgtggtccagccgtgggagtcctgagactctcctgtacagcctctggcttcaccttcattacctatggcatgcacgtcgggtccnccagacctccgaggcgagggggctgggagtggggtggctaggtttacttcattagtgatcgggaaatgtagtacttctattcgagtacctccgtagaaacggcctatccgaccgtctcccgaagacgaacacttccaggccacacgtctgtatctgacaaatgaaacngtaccagagaagcgtagacgacacggtctacgtgtattaacgtgagtacgaaagttactttactaagtaagg

SEQ ID NO: 410163 - DNA, 527 bp, Homo sapiens
  misc_feature: GZ8MTXP02JCSYD.11.71.G05.1.454.CMB.2.raw
  modified_base (267)..(267): a, c, t, g, unknown or other
  modified_base (307)..(307): a, c, t, g, unknown or other
  modified_base (404)..(404): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggagtccctgagctctctgtacagcctntgcttcaccttcattacctatggcatgcacgtcgggtccncagacctcgaggcgaggggctgggagtgggtgctagttattcatagtgataggatgtgtacttctattcagtactcgtagaacggctatcaccgtcnccagagacatccagccacacgtctagtactctagacaaatcgaacagacctagacgtagcgaggaacggacacggtctcgtagttattaacgtgtagaacggtaaatacgtttacaagtacgg

SEQ ID NO: 410164 - DNA, 564 bp, Homo sapiens
  misc_feature: GZ8MTXP02HG93M.11.71.G05.1.454.CMB.2.raw
  modified_base (294)..(294): a, c, t, g, unknown or other
  modified_base (357)..(357): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactgggaggagtcgtgggggaggcgtggtccagcctgggaggtccctgagactctcctgtacagcctctggcttcaccttcattacctatggcatgcacgtgggtccnccagacctccgaggcgagggggctgggagtgggtgctagttattcatatgataggaaaatgtntactttcattcagtactccggtagaacggggcctaattccaccgtctaccgaagacgactaaacttccgaggccaacgacgctagtatctagacaaatagaacagcctagagagcgtaggagacgacggtcgtagttagttaactacgttaggtacgacgtaaagtatttaacgtagtaggaggtagacggtaacgggggtctttcg

SEQ ID NO: 410165 - DNA, 580 bp, Homo sapiens
  misc_feature: GZ8MTXP02F7FLC.11.71.G05.1.454.CMB.2.raw
  modified_base (262)..(262): a, c, t, g, unknown or other
  modified_base (309)..(309): a, c, t, g, unknown or other
  modified_base (316)..(316): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagctctcctgtacngcctctggcttcaccttcattacctatggctatgcacgtgggtcccnccagacnccgaggcggaggggctgggaggtggggtggtactagtttattcatagtaggaattagggaattgtagtactttactattacagtaccgtcgtaggaacggccgtatccgtaccgtcaccgagacgactactcgagccacacgtctagtactcagacaaatacgaaacacgaccgtagagacgcgtaggaacggacgtacggtcgttaggttacgttaacgttaacgtaggtaacgtaacgtaaagtttacttacgtaagtacgg

SEQ ID NO: 410166 - DNA, 585 bp, Homo sapiens
  misc_feature: GZ8MTXP02GBMYS.11.71.G05.1.454.CMB.2.raw
  modified_base (314)..(314): a, c, t, g, unknown or other
  modified_base (344)..(344): a, c, t, g, unknown or other
  modified_base (377)..(377): a, c, t, g, unknown or other
  modified_base (478)..(478): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggttgtccagtgtcaggtgcaacgtggaggagtcgtgggggaggcggtggtccagccgtggggacgtccctgagactctcctgtacagcctctggcttcaccttcattacctatggcatgcacgtggtccncagctccgaggcgaggggctgggagtgggngctagttattcatatgataggaatgagtacttntattcagtctccgtagaacggcctattccgaccgtctccaagacgactaaacttccgaggtaccaaccacgctagtactcgtacgacaaaagtcgaaaacngtacccgtagaaggacgacgtaggaacggaaccgacggtacgtacggttagttaacgttaacgtaggtacggtaacggtaaaagttatttacgtaagttaaacgggg

SEQ ID NO: 410167 - DNA, 682 bp, Homo sapiens
  misc_feature: GZ8MTXP02GQBVS.11.71.G05.1.454.CMB.2.raw
  modified_base (268)..(268): a, c, t, g, unknown or other
  modified_base (309)..(309): a, c, t, g, unknown or other
  modified_base (339)..(339): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggagcgtggtccagcctggggagtccctgagactctcctgtacagcctntggcttcaccttcattacctatggcatgcacgtgggtcccncagactccaggcgagggggctggagtgggngctagttatcatatgattgggaatcgtagtactttactattcaagtaccgtccgtaggaaacgggtccgtatttccgaacccgtttccacccgaagtaacgtaacctaaacgtttccccgaaacgggtccaaaccgtaaccccgtgttacggttaaactccgtaacggtaaccaaaaggttacgaaaaccgacggtacccgtacgggaacggtaaggacccgttaaggggaaaccgggtaaacccggaacccggggttcgttacggttacggtttaaaattccgttaggtacggtaaaacggtaaaacggtttaaacttttacgttaaaggtttaaacggggg

SEQ ID NO: 410168 - DNA, 540 bp, Homo sapiens
  misc_feature: GZ8MTXP02IFK9F.11.71.G05.1.454.CMB.2.raw
  modified_base (290)..(290): a, c, t, g, unknown or other
  modified_base (499)..(499): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcactgggtccnccagacctccgaggcgagggggctgggagtgggtggctagttatttcatatgataggaaatgtgacttctattcagtactccggtagaacgggccgtattccaccgtctcccagacgacaacttccacgcacacgctgtatctgacaatgaacacgcctagacgagcgtagacggacgacggtctgtgtattacgtgtagacgtaagtnttaacgtagtaggtacggtagacggtacggggtcgtttacg

SEQ ID NO: 410169 - DNA, 594 bp, Homo sapiens
  misc_feature: GZ8MTXP02F7GOE.11.71.G05.1.454.CMB.2.raw
  modified_base (247)..(247): a, c, t, g, unknown or other
  modified_base (292)..(292): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggaggtccctgagactctcctgtacngcctctggcttcaccttcattacctatggcatgcacgtgggtccncagacctccgaggcgagggggctgggaggtggggtgctagtttattcatatgataggaaatgtagtacttctattcagtactccggtagaacggggtcctacttccgacccgtctacccagacactaacttccaggacaacacgtctagtactctagacctaaatacgaaacacgaccctaggaggacgcgtaggaacggacgacggtacgttagttagttaacttacgtggtacgaacgtaaaggttaacttaacgtaaagtaaggtagggtacggtaacggtaacgggggtctttaacgg

SEQ ID NO: 410170 - DNA, 528 bp, Homo sapiens
  misc_feature: GZ8MTXP02HKQ02.11.71.G05.1.454.CMB.2.raw
  modified_base (308)..(308): a, c, t, g, unknown or other
  modified_base (415)..(415): a, c, t, g, unknown or other
  modified_base (452)..(452): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggagcgtggtccagcctgggaggtccctgagactctcctgtacagcctctggcttcaccttcattacctatggcatgcactgggtccnccagacctccgaggcgagggggctggagtgggtggctagttattcatatgatggaatgtgacttctattcagtactccgtagaacggccgattcaccgtctccaganacattccaggcacacgtctgtatctgacaaatgaacngacctgagtacgcgtaggacggacgacggctaggtgttattaacgtgtacgacgtaaaagtctttacgtagtaagg

SEQ ID NO: 410171 - DNA, 593 bp, Homo sapiens
  misc_feature: GZ8MTXP02HDO1U.11.71.G05.1.454.CMB.2.raw
  modified_base (246)..(246): a, c, t, g, unknown or other
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagccgtgggagtccctgagactctcctgtacngcctctggcttcaccttcattaccatggcatcgcacgtcgggccnccagacctccgaggcgaggggctggaggtgggtgctagtttatcatagtgataggaaatgtgtacttctattcgacgtactccgggtagacggggtcctattcccgaccgtctaccgaagacgaactaacttaccgacggaccacgtacgtactgtactcgtagactaaagtacgaactacgccgtagagacgcgtaggaacggacgacggtacgtaggttagttacttacgtagtacgaacgtaaagttacttaagtaagtacggtacggtacggtaaccgggttacggggtcgtttacgg

SEQ ID NO: 410172 - DNA, 652 bp, Homo sapiens
  misc_feature: GZ8MTXP02H46JY.11.71.G05.1.454.CMB.2.raw
  modified_base (250)..(250): a, c, t, g, unknown or other
  modified_base (303)..(303): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagccgtggggaggtccctgagactctcctgtacngcctctggccttcaccttcacttacctagtggcatcgactacgtcgggtcccnccagacctccgaggcgaggggctgggaggtgggtgctagttatttcatatgagtaggtaaaatgtgtactttactattcgaacgtactccggtagaaacgggtcctaatttccgacccgtctacccgaagaacgtaacctaacgttacccgaacggtaccaaccgaccgtcttaggtacttaccgtagaactaaaagtacggaaactacggtacctaggaagacgtacgtaggacgggaaccgacggtacgttaggttagttaacgttacgtggttacgaacgttaaaagttcttttaacgaagttaacggacgggttacgtaaccggggttacgggggtactttacgg

SEQ ID NO: 410173 - DNA, 515 bp, Homo sapiens
  misc_feature: GZ8MTXP02JEVDA.11.71.G05.1.454.CMB.2.raw
  modified_base (305)..(305): a, c, t, g, unknown or other
  modified_base (393)..(393): a, c, t, g, unknown or other
  modified_base (398)..(398): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagctctcctgtacagcctctggcttcaccttcattacctatggcatgcactgggtccnccagactcaggcaggggctggagtgggtggctagttattcatatgatggatgtgacttctattcagactccgtgacggcatcacgtcncaganacatccaggcacacgctagtactctagacaaatcgaacagacctagagacgcgtaggacggacgacggcttggtagttacttaacgtgtacgacgtaaagtactttactagtaacgg

SEQ ID NO: 410174 - DNA, 679 bp, Homo sapiens
  misc_feature: GZ8MTXP02G9CE8.11.71.G05.1.454.CMB.2.raw
  modified_base (248)..(248): a, c, t, g, unknown or other
  modified_base (290)..(290): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggaggagtcgtgggggaggcgtggtccagccgtgggacgtccctgagactctcctgtacngcctctggcttcaccttcattaccatgcatgcacgtggtccnccagacctccgaggcgagggggctggggaggtggggtggactaggtttactttcagttagtgaacgttaagggaaaacttaggttacgtacctttacgttaatttccgaagtaacccgttccgggtaaggtaaacgggggtccctagttccccgtaacccgttcctacccgaaggaacgtaaacctaaacgttacccgaacggtaccaaccgtacgtcctagttaacgtccttaggaacctaaaatacgaaaccgaacgcccgtaggaagacggcgtaggaacgggaccgacgggtacgtggttacttaagtttacgtacggtagtaaccgtaaagttatttaacgtaagttacgggtaggtaggtaccgggtacggggtcgtttacgg

SEQ ID NO: 410175 - DNA, 652 bp, Homo sapiens
  misc_feature: GZ8MTXP02HO1YX.11.71.G05.1.454.CMB.2.raw
  modified_base (211)..(211): a, c, t, g, unknown or other
  modified_base (223)..(223): a, c, t, g, unknown or other
  modified_base (253)..(253): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcggtgtttcgcgtaggctcttaagaggtgtcagtgtcaggtgcaatggaggagtgggnggggagcgtgcngcgtgggcgtcctgacgtctctcgtgtacncgctcgtcgtctcctacctctacttactagtcgtctatgcgtcgtcggtccgaccgacgaccgtaccgacggacgggacggggtcggtggtaggtgggtcggtcgtacgttacttacgtagtagtagtagtaagtagtagtagttacttacttacgtacgtacgtaccgtaccgtacggtaacggtacgtacgttaccgtacccgtaccgtaccgtaacgtaacgtaacgtacgtaccgacgaccgaccgtacgtacgtacgtactacgtacgtaacgtaaacgtaacgaacgtaacgtacgtacgacggtacgtacgtacggaacggacgtacggtacgtacgttacgttagttaacgtagtaacggtaacgtaacgttacgttacgttaacgtaagg

SEQ ID NO: 410176 - DNA, 594 bp, Homo sapiens
  misc_feature: GZ8MTXP02J2ZV0.11.71.G05.1.454.CMB.2.raw
  modified_base (255)..(255): a, c, t, g, unknown or other
  modified_base (260)..(260): a, c, t, g, unknown or other
  modified_base (299)..(299): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggacgtccctgagactctcctgtacngcctntggcttcaccttcattacctatggcatgcactgggtccncagactccgaggcgagggggctgggagtgggtgctagtttattcatatgataggaaaatgtgtacttctattcagactccggtagaaacgggccgtaattccaccgtctaccagacgactaatccagcacacgctgtactcgtgactaaagtagaaaccgcgtacgaggacgacgtacgtacggacggtaccgacggtctacggttacgttaacgttacgtacggttaacgtaacgtaaagtttacgtttaacgtaagttaacggtacgggttaacggtaaccgggttacggggg

SEQ ID NO: 410177 - DNA, 570 bp, Homo sapiens
  misc_feature: GZ8MTXP02HBZGL.11.71.G05.1.454.CMB.2.raw
  modified_base (301)..(301): a, c, t, g, unknown or other
  modified_base (369)..(369): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcacgtgggtccnccagacctccgaggcgagggggctggaggtggggtgcagtttattcatatgataggaaatgtgacttntattcagtactccgtagaacgggccgtattcgacccgttctcccgagaacgaactaacttccgaggacacgacgactgtactctagacaaagtgaaacacgcctagacgagcgtagacggaacacggcttgtagttacttacgtcgtacgtaaagtaaagtatttacgtaagtaggtaggtacggtaacgggttacggggg

SEQ ID NO: 410178 - DNA, 713 bp, Homo sapiens
  misc_feature: GZ8MTXP02GGS1Q.11.71.G05.1.454.CMB.2.raw
  modified_base (262)..(262): a, c, t, g, unknown or other
  modified_base (306)..(306): a, c, t, g, unknown or other
  modified_base (357)..(357): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggagcgtggtccagcctgggacgtccctggagactctcctgtacagcctntcggcttcaccttcattaccatcggcatgccacgtcgggtcccnccagcctccagggcgagggggctgggagtggggtgctagtttattcatagngataggaaaattggtactactttcgtattcaacggtaccgttccggtaggaaacggggtcccgtaacgtttccgacccgttctacccgaagaccgtaactaaacgtttccgaacgggaccaaccgtaaccgtccttacggttaacttaccgttacggaacctaaaagttacgaaaaccgacggtacccgtaggaaacggacggtaccgtaggggaaccggtaaccgacgggtaccgttacggttacggtttaactttaaccggtggttaacggtaaaccggttaaaagttaacgtttttacggtaaacgttaaagggtaacggggtttacggtaaccgggggtttaacccgggggg

SEQ ID NO: 410179 - DNA, 565 bp, Homo sapiens
  misc_feature: GZ8MTXP02FOM4I.11.71.G05.1.454.CMB.2.raw
  modified_base (246)..(246): a, c, t, g, unknown or other
  modified_base (291)..(291): a, c, t, g, unknown or other
  modified_base (325)..(325): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacngcctctggcttcaccttcattacctatggcatgcacgtgggtccnccagactccgaggcgagggggctgggagtggggngctagtttattcatatgataggaaatgtgtacttctattcagtactccggtagaacgggccattccaccgtctccagagacattcacggacacacgcgtacgtatctacgacaaatgaaacagacctgagagcgtaggacggacgacggtcgtaggttgttaacttagtaggtacgtaacgtaaagttagttaacgtaagtaacggagggtacggtaccggtacgggggtacgtttacgg

SEQ ID NO: 410180 - DNA, 573 bp, Homo sapiens
  misc_feature: GZ8MTXP02IUJW7.11.71.G05.1.454.CMB.2.raw
  modified_base (246)..(246): a, c, t, g, unknown or other
  modified_base (251)..(251): a, c, t, g, unknown or other
  modified_base (291)..(291): a, c, t, g, unknown or other
  modified_base (330)..(330): a, c, t, g, unknown or other
  modified_base (366)..(366): a, c, t, g, unknown or other
  modified_base (472)..(472): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacngcctntggcttcaccttcattacctatggcatgcacgtgggtccnccagactccaggcagggggctggaggtgggtgctagttnttcatatgataggaaatgtgtacttgtacttcgtanacgtccgtgtaacgggcggacttacgtacccgtctccacgagactaactactacgacgacacgcgtacgtatactcgacgtaatagaacgacgtcgacgtagacgngtacggacggacgacggtacgtagtacgttacgttacgtacgtgaacgtagttaagttaagttacgaacggtagtacggtacggtacgggttacggttacg

SEQ ID NO: 410181 - DNA, 536 bp, Homo sapiens
  misc_feature: GZ8MTXP02G994O.11.71.G05.1.454.CMB.2.raw
  modified_base (246)..(246): a, c, t, g, unknown or other
  modified_base (290)..(290): a, c, t, g, unknown or other
  modified_base (322)..(322): a, c, t, g, unknown or other
  modified_base (357)..(357): a, c, t, g, unknown or other
  modified_base (433)..(433): a, c, t, g, unknown or other
  modified_base (466)..(466): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacngcctctggcttcaccttcattacctatggcatgcactgggtccnccaggcctccgaggggaggggctggagtgggngccaaacataaacgccagagtggagtagtaaaacngtatgtagactcgtgtgggagggtccgttcaccatcctcgagagacaacgcaaagaatgacgataatatacctaanagatagaacagcctagcgagccgagacacggtntgtattacgtcgtggtcggactccgtgtcgtcgctaacgtcgtacgtccggtacggtggacgtacgacgg

SEQ ID NO: 410182 - DNA, 577 bp, Homo sapiens
  misc_feature: GZ8MTXP02HO985.11.71.G05.1.454.CMB.2.raw
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccagcctgggagtccctgagactctcctgtacagcctctggcttcaccttcattacctatggcatgcacgtgggtccnccagacctccgaggcgagggggctgggaggtggggtgctagtttattcatatgataggaaatgtgtacttctattcatactccgtagaacgggtccattccaccgtctaccagaagacaacttcgacgcacacgctgtatctagactaaatagaacgacgcctagagagcgtaggacggaacgaccgggtctagggttagttaacgtttacgtacgtacgaacgtaaaagttagtttaacgttaagtaacggtaggtacggtacggttacgggggtacgtttacgg

SEQ ID NO: 410183 - DNA, 626 bp, Homo sapiens
  misc_feature: GZ8MTXP02JVVPW.11.71.G05.1.454.CMB.2.raw
  modified_base (247)..(247): a, c, t, g, unknown or other
  modified_base (252)..(252): a, c, t, g, unknown or other
  modified_base (294)..(294): a, c, t, g, unknown or other
  modified_base (330)..(330): a, c, t, g, unknown or other
  modified_base (370)..(370): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccagccgtgggagtccctgagactctcctgtacngcctntggcttcaccttcattacctatggcatcgcacgtcgggtccnccagactccgaggcgagggggctgggaggttggggngtctagtttattcgatagtgaagtggaaattgtgtacttntattcagtcttccggtagaacggggtcctattcccaccgtcctacagacgactaacttccgaggccacgacgtctacgtatcgtacgactaaagtacgaaaccgagtacccgtaggacggtaaggtccgtaggaacggtacgaccgggttacgtaggttacggttaacgtttacggtacgtacggtaacgtaaaagtttagtttaacgtaaaggtaggtacggggttaggtaccgggttaacgggggtctttacgg

SEQ ID NO: 410184 - DNA, 642 bp, Homo sapiens
  misc_feature: GZ8MTXP02JN419.11.71.G05.1.454.CMB.2.raw
  modified_base (292)..(292): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtggggacgtccctgagactctcctgtacagcctctggcttcaccttcattaccatggcatgcacgtgggtccnccagacctccgagggcgagggggctgggaggtggggtgctagtttattcatatgaataggaaatgtgtacttactattcagtactcggtagaacggggcctaattcccgacccgtctacccagtacgaactaacttaccgacggacctaacgaccggtaccttaggttactaccgttaaggaacctaaaagttacggaaaaccgtaacgacccgttaggaaccggtaggccgtagggaaccgggtaaccgacggtacgttagggttagttaacgttaacgtggtacggtaaccgtaaaagttatttaagtaagtacggtaagggtcgtacgggtacgggggtctttacgg

SEQ ID NO: 410185 - DNA, 565 bp, Homo sapiens
  misc_feature: GZ8MTXP02G6MYE.11.71.G05.1.454.CMB.2.raw
  modified_base (292)..(292): a, c, t, g, unknown or other
  modified_base (362)..(362): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattaccctatggcatgcacgtgggtccnccagacctccgaggcgagggggctgggaggtggggtgctagtttattcatatgataggaaatgtgacttntattcagtctcgtagaacgggtcctattccaccgtctaccgagacgactaatccacggcacgacgctgtatctagacaaatagaacagccgtagacgagcgtaggacggacacgggtctaggttgttaacgttacgtgtacggtaacgtaaagttattaacgtaagtaggtacgggtacgtacggtacgggggtactttacgg

SEQ ID NO: 410186 - DNA, 531 bp, Homo sapiens
  misc_feature: GZ8MTXP02IY830.11.71.G05.1.454.CMB.2.raw
  modified_base (307)..(307): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggagtccctgagactctcctgtacagcctctggcttcaccttcattacctatggcatgcacgtgggtcccnccagactcgaggcgagggggctgggagtggggtggctagttatttcatatgataggatgtgacttctattcagactccgtgaacggccattcaccgtctccagagacatccaggcacacgctgtactctagacaaatgaaacagaccgtgaagacgcgtaggacggaccgacggctaggtcgttaagttcgtgtacgacgtaaagtactttacgtaagtaaggg

SEQ ID NO: 410187 - DNA, 635 bp, Homo sapiens
  misc_feature: GZ8MTXP02I4J2Q.11.71.G05.1.454.CMB.2.raw
  modified_base (279)..(279): a, c, t, g, unknown or other
  modified_base (305)..(305): a, c, t, g, unknown or other
  modified_base (337)..(337): a, c, t, g, unknown or other
  modified_base (354)..(354): a, c, t, g, unknown or other
  modified_base (375)..(375): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggagtccctgagactctcctgtacagcctctgcttcaccttnattaccatggcatgcacgtcggtccnccagcctccgaggccgaggggctggaggtggnggctagttattcattangtagtaggaatgtataccttntattcgagtacctccggtaggaacggcctattccgacccgtctcccaagacgtaaccaacttcccgaaggcccaacgacgtctacggtactcgtagaacctaaagtacgaaacgacgtaccgtaggaacggtacggtacgttaagggaacgggtaacccgaacgggtccgtttacgggttaatttaaacgtttaaccggtacggttaacggtaaaccggttaaaaagtttacgttttaaccggtaaagtttaaacggggg

SEQ ID NO: 410188 - DNA, 544 bp, Homo sapiens
  misc_feature: GZ8MTXP02F793W.11.71.G05.1.454.CMB.2.raw
  modified_base (265)..(265): a, c, t, g, unknown or other
  modified_base (364)..(364): a, c, t, g, unknown or other
  modified_base (370)..(370): a, c, t, g, unknown or other
  modified_base (399)..(399): a, c, t, g, unknown or other
  modified_base (451)..(451): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctctgtacagcctntggcttcaccttcattacctatggcatgcacgtggtccgcaagctccgaggcgagggggctgggagtggggtggctagtttatcatatgataggatgtntacttntattcagtctcgtgacggctatcacgtcnccagacgacatccaggccacacgtctagtatctacgactaaagtacgaaacncgacctagaagacgacgtagggaacggacgacgggcttacggttgttaacttaacgttgtacggtacgtaaaagtatttaccgtaagtaaggg

SEQ ID NO: 410189 - DNA, 646 bp, Homo sapiens
  misc_feature: GZ8MTXP02H4HDM.11.71.G05.1.454.CMB.2.raw
  modified_base (269)..(269): a, c, t, g, unknown or other
  modified_base (323)..(323): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggaggcgtggtccaggccgtggggagtccctggagtactctcctgtacngcctcgtggccttcaccttcaattacctatcggcagtgcctacgtcgggtcccnccagacctccgaggcgagggggctggggaggtggggtcggctagtttattcaatagtgaagttaggtaatggtatacctttcgtaattcgaacgtaccgtccgtaggaaacggtcccgattccgaacccgttctacccgagaacgtaactacgttaccgaggtaccacgtacgtcttacgtatccgtagaacctaaagtacgaaactacgaccgtagaacggacgacgtacggaaacggtaccgaacgggtcgttaggttagttaactttaaccggtaggtaaccgtaacggtaaaatttacgttttacgtaaagtaacgggg

SEQ ID NO: 410190 - DNA, 614 bp, Homo sapiens
  misc_feature: GZ8MTXP02HKLXP.11.71.G05.1.454.CMB.2.raw
  modified_base (259)..(259): a, c, t, g, unknown or other
  modified_base (287)..(287): a, c, t, g, unknown or other
  modified_base (339)..(339): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcgtggtttcgcgttaggctctttaagaggtgtcagtgtcaggtgcaatggaggagtcgtgggggagcgtggtccagcctgggaggtccctgagactctcctgtacngcctgtcgtcttcaccttcacttactangacatgctacgtcggccacagacctcgaggcggaggggtctgggaggtgggngtacgtacgttattactatagtagtagtaagtagtagtagtacttacttacttactacgtacgtaccgtacggtaacggtaccgtacgttaccgtacccgtaccgtaccgaacgaacgtaacgtaacgtaccgtacgacgacgacgtacgtacgtacgtacgtacgaacgtaaacgtaacgaacgaacgtacgtacgacgacgacgtacggacgacgacgtacgtacgtagtacgtaacgtacgtacgtacgtaaacgtacgttacgtaagtaag

SEQ ID NO: 410191 - DNA, 592 bp, Homo sapiens
  misc_feature: GZ8MTXP02F9CZM.11.71.G05.1.454.CMB.2.raw
  modified_base (262)..(262): a, c, t, g, unknown or other
  modified_base (303)..(303): a, c, t, g, unknown or other
  modified_base (426)..(426): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggacggtccctgagactctcctgtacagcctntggcttcaccttcattacctatggcatgcacgtgggtcccnccaagacctcccgagggccgagggggtctgggaggtggggtggactagttatttcattagtgataggaaaatgtgtacttctattcagtacctcgtaggaagggcctattcaccgtctcaganacatcagcacacgctagtatctagactaaagtcgaaacgacgactaggaacgacgtacgtaggaacggtacgacggtctggtacgttaagtttacgtaggtcggtaaacgtaaagttacgtttacgtaaagtaaggtaggtacgggtaaccgggtttaaccggggg

SEQ ID NO: 410192 - DNA, 515 bp, Homo sapiens
  misc_feature: GZ8MTXP02F4I61.11.71.G05.1.454.CMB.2.raw
  modified_base (181)..(181): a, c, t, g, unknown or other
  modified_base (420)..(420): a, c, t, g, unknown or other
  modified_base (424)..(424): a, c, t, g, unknown or other
  modified_base (449)..(449): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcaactggaggagtcgtgggggagcgtggtccagccgtgggagtccctgacgactctcctgtacagcctctggcttcaccttcattacctatggcatgcacgtggtccgccagactccaggcgagggggctgggagtggggtgctagttattcatatgattggaatgtgacttctattcagctccgtgaacggcattcaccgtctccagagacatcagccanacgntgtactctgacaaatgaacaggtcngagcgacgtgacgacgacggctagtcgtataacgtggtacgacgtaaagtactttacgtaataggg

SEQ ID NO: 410193 - DNA, 601 bp, Homo sapiens
  misc_feature: GZ8MTXP02HKT2X.11.71.G05.1.454.CMB.2.raw
  modified_base (309)..(309): a, c, t, g, unknown or other
  modified_base (382)..(382): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagccgtgggagtccctgagactctcctgtacagcctctggcttcaccttcattacctatggcatgcacgtgggtcccncagacctccgaggcgagggggctgggagtggggtgctagttattcattatgagtaggaacttgtagtactttntattcgaacgtaccgtccgtaggaacgggtccgtaacgttccgtacccgtcctacccgaaggacgtaaaccgtaacttccgaaggtccaaccgacggtcttagtaacttcgtacgaactaaaagtcgaaactcgaccgtagacgacgtcgtaggacggaccacggctagttacgtaagttcgtagtacggacggtaaagttactttacgtaagttaggg

SEQ ID NO: 410194 - DNA, 632 bp, Homo sapiens
  misc_feature: GZ8MTXP02IICHC.11.71.G05.1.454.CMB.2.raw
  modified_base (254)..(254): a, c, t, g, unknown or other
  modified_base (295)..(295): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggaggcgtggtccagccgtgggacggtccctgagactctctgtacagcctcnggcttcaccttcattacctatggcatgcacgtcgggtcccnccagacctccgaggcgaggggctgggaggtgggtggctagtttattcatatgataggaaaatgtatactttctattcaagtacctccggtagaacggggtcctaactttcccgaccgttcctaccgagaacgaactaacgttacccgacggacctaaccgaccgtacgttacgtacttacctacgaactaaaagtacggaaacacgaccgtaggaacgagcgtaggacggaacgaaccgggtcgttaggttagttaacgttacgtaggttacgaacgtaaagttaagtttaacgtaagtaggtacggtaggtaccgggttaacgggggtcgtttacg

SEQ ID NO: 410195 - DNA, 593 bp, Homo sapiens
  misc_feature: GZ8MTXP02HEG34.11.71.G05.1.454.CMB.2.raw
  modified_base (243)..(243): a, c, t, g, unknown or other
  modified_base (261)..(261): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggtttcctcgttgctctttaagaggtgtccagtgtcaggtgcaacgtggaggagtcgtgggggagcgtggtccagcctgggacgtcctgagactctcctgtacngcctctgccttcaccttnattacctatggcatgcctacgtcgggtcccacctagacctccgagggccgagggggctggggaggtggggtggactagtttattcattataggtagtaggaaaattgtcgtactttcttattcgaagtacttccggtagaacggggcctagttcccaccgtctacccgagacgaactaacgttaccgacgaccacgacgtctacgtactctagtactaaagacgaactacgaccgagacgagtacgagacgacgacggtctggtattacgtacgtgtacgacgtaagttattaacgtaagtacggtacgtacgtacgggtacgggtcgttcg

SEQ ID NO: 410196 - DNA, 577 bp, Homo sapiens
  misc_feature: GZ8MTXP02GPZL2.11.71.G05.1.454.CMB.2.raw
  modified_base (246)..(246): a, c, t, g, unknown or other
  modified_base (291)..(291): a, c, t, g, unknown or other
  modified_base (354)..(354): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggagtccctgagactctcctgtacngcctctggcttcaccttcattacctatggcatgcacgtgggcccnccagacctccgaggcggaggggctgggaggtgggtgctagtttattcatatgagtagaaatgntacttcttattcagtacctccggtagaacgggcctattaccgaccgttcctacccgaagacgaactaacttcccgagggaccaacgacgtctagtactctacgactaaatcgaacacgacctaggagacgctagacggacgacgtcgtgtagttacgttacgtggacgtaacgtaaagtacttaacgtagtacgtaggtacgtacggtacgggggtctttacg

SEQ ID NO: 410197 - DNA, 609 bp, Homo sapiens
  misc_feature: GZ8MTXP02GWGDL.11.71.G05.1.454.CMB.2.raw
  modified_base (250)..(250): a, c, t, g, unknown or other
  modified_base (291)..(291): a, c, t, g, unknown or other
  modified_base (504)..(504): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggaggtccctgagactctcctgtacagcctntggcttcaccttcattacctatggcatgcacgtgggtcccnccagacctccgaggcgagggggctgggaggtggggtggctaggtttatttcatagtgagtaggaaattgtgtacttctattccgaagtacctccggtaggaaacggggtccctaatttcccgaacccgttcctacccgaagaacgtaacctaaacgttacccgaggccaaccgacgtctagtactctagactaaagtcgaacagcctagacgngtacgtaggacgacgacggtactgtagttaacgttacgtggtacgaacgtaaagtactttaacgtagtaacggtaggtacgtacgggtacgggggtcgtttacgg

SEQ ID NO: 410198 - DNA, 622 bp, Homo sapiens
  misc_feature: GZ8MTXP02GHGS3.11.71.G05.1.454.CMB.2.raw
  modified_base (246)..(246): a, c, t, g, unknown or other
  modified_base (292)..(292): a, c, t, g, unknown or other
  modified_base (327)..(327): a, c, t, g, unknown or other
  modified_base (362)..(362): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggacggtcctgagactctcctgtacngcctctggcttcaccttcattacctatggcatgcacgtgggtcccnccagacctccgaggcgagggggctgggaggtgggngctagtttattcatatgataggaaatgtgtacttntattcgaagtaccttccggtaggaacggggccctatttacccgaacccgtcctacccgaagaacgaacctaaacttacccgacggacaaccgaacgtcctagtaacttccgtagaacctaaaagtacgaaaccacgtccctaggaagacgtcgtaggaacggaccgaacggtcgtaggtagttaacttacgtaggtagaacgtaaaagttatttaacgtaagtaacggtacggtacgaccggttacgggggtctttacgg

SEQ ID NO: 410199 - DNA, 617 bp, Homo sapiens
  misc_feature: GZ8MTXP02IDOQ6.11.71.G05.1.454.CMB.2.raw
  modified_base (247)..(247): a, c, t, g, unknown or other
  modified_base (252)..(252): a, c, t, g, unknown or other
  modified_base (294)..(294): a, c, t, g, unknown or other
  modified_base (365)..(365): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggagcgtggtccagcctggggaggtccctgagactctcctgtacngcctntggcttcaccttcattaccctatggcatgcacgtgggtcccnccagacctccgagggccgaggggggctgggaggtggggtggctagtttatttcatatgataggaaaatgtnactttctattcagtacctccggtagaacggggtccctattcccgaccgttcctaccgaagacgaactaacttccgaggcaacgacgctgtactctagactaaagtacgaacagaccgtagacgacgtcgtaggacgggtacgacggtcgtaggttaggttaactttacgtaggttacgaacggttaaaagttagtttaacgtaagtaaggtacgggtacggtaaccgggtttacgggggtacttttaccggg

SEQ ID NO: 410200 - DNA, 562 bp, Homo sapiens
  misc_feature: GZ8MTXP02IOH4X.11.71.G05.1.454.CMB.2.raw
  modified_base (305)..(305): a, c, t, g, unknown or other
  modified_base (462)..(462): a, c, t, g, unknown or other
tcagcgagagataccacgaccggtgctcgatttagtgtcgtcgcaagagagaggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggaggtccctgagactctcctgtacagcctctggcttcaccttcattacctatggcatgcactgggtccnccagctccgaggcgagggggctgggagtggggtggctaggttattcatatgatggatgtgtacttctattcagtactccgtagaaggccgtattccaccgtctcccgagacgacaatccaaggcacacgtctgtactcctagcaaaagtcgaaaacncgtaccgtaggaacgacgcgtaggaacggaacgacggtcgttacgttagttaacgttaacgtaggttacggaacgtaaaagttactttacgtaagttagg

SEQ ID NO: 410201 - DNA, 634 bp, Homo sapiens
  misc_feature: GZ8MTXP02H84PX.11.71.G05.1.454.CMB.2.raw
  modified_base (354)..(354): a, c, t, g, unknown or other
  modified_base (569)..(569): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagttgggctgagcttgggttttcctcgttgctcttttaagaggtgtccagtgtcaggtgcaactggaggaggtcgtgggggaggcgtggtccagccgtggggacggtccctgagactctcctgtacagcctctggtccttcaccttcattaccctatggcatgccacgtcgggtccgccagacctccgaggccgagggggctgggaggtgggtggctagttattcaattangtatagggtaaaatgtcgtactttctatttcacgtacctccggtaggaaccgggtcccgtatttcccgacccgttcctaccgaagaacgtaaactaaccgttccgaacgggtaccaaccgaccgtccttaggtaacttctaggaactaaaagtcgaaacacgtaccagagtacgacgtaggaacggacgaacggtcgtaggttgtaactttacgnggttacgaacgtaaaggtactttaagtaataggacggtaggtaaccggtacgggggttcttacgg

SEQ ID NO: 410202 - DNA, 592 bp, Homo sapiens
  misc_feature: GZ8MTXP02JN4L8.11.71.G05.1.454.CMB.2.raw
  modified_base (313)..(313): a, c, t, g, unknown or other
  modified_base (354)..(354): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggaggcgtggtccagccgtggggacgtccctgagactctcctgtacagccctctggcttcaccttcattaccctatggcatgcactcgggccnccagcctccaggcgagggggctgggagtggggtgctagttnttcatatgatggaatgtgtacttctattcagtactcgtagacggccattccaccgtctccagacgacaatccaaggcacacgctagtatctagacaaatcgaaacagcctaggacgacggaccgtagggaaacgggtaccacgggtccgttacggttacggttaacgtttaacggttaggttaaccgggtaaacggtaaaaggtttacgtttttaaccggaaaggtttaaaacggggg

SEQ ID NO: 410203 - DNA, 513 bp, Homo sapiens
  misc_feature: GZ8MTXP02FJJBI.11.71.G05.1.454.CMB.2.raw
  modified_base (290)..(290): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattaccctatggcatgcactgggtccnccagactccaggcagggggctggagtgggtgcagttatttcatatgatggaaatgtgacttctattcagactccgtgaagggcgattcaccgtctccagagacaattccaggcacacgctgtatctagcaaatgaaacagcctagagagctgaggacacggctggtgtacttacgtgtcgacgaaagtatttcgtataggaggtggacgtacgggggctttcg

SEQ ID NO: 410204 - DNA, 532 bp, Homo sapiens
  misc_feature: GZ8MTXP02GFC7C.11.71.G05.1.454.CMB.2.raw
  modified_base (267)..(267): a, c, t, g, unknown or other
  modified_base (303)..(303): a, c, t, g, unknown or other
  modified_base (333)..(333): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggaggagtcgtgggggagcgtggtccagcctgggagtccctgagactctcctgtacagcctntggctcacttcattacctatgcatgcactgggtccnccagactccaggcgaggggctggagtgggngctagttattgatatgatggaatgtgtaacttctaattcagtactccgtagaaacggcgtattcaccgtctccagacgacaattccgagtcacgacgctgtacactagacaaatcgaaacacgacctggaagaggacgtaggacggaacgacggtactgtagtattaacgtgtacgacgtaaagtagttactagtaagg

SEQ ID NO: 410205 - DNA, 571 bp, Homo sapiens
  misc_feature: GZ8MTXP02HCW73.11.71.G05.1.454.CMB.2.raw
  modified_base (314)..(314): a, c, t, g, unknown or other
  modified_base (360)..(360): a, c, t, g, unknown or other
  modified_base (378)..(378): a, c, t, g, unknown or other
  modified_base (383)..(383): a, c, t, g, unknown or other
  modified_base (442)..(442): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggaggcgtggtccagccgtggggagtccctgacgactctcctgtacacgcctctggccttcaccttcacttacctatcggcatgcctacgtcgggtccnccagacctccgaggcggaggggctgggagtggggtgctagtttatnatagtgagtagaaatgtnacttntattcacgtctcggagacgggcctatccaccgtctcagacaactactccgagacacgcnctgtactctagactaatacgaacacgcctagacgagcgtaggacggacacggtctcggtattacgttcgagtcgtaaagtaagttactttacgtacgtaaggacggttacggaacgggtttaccggggg

SEQ ID NO: 410206 - DNA, 673 bp, Homo sapiens
  misc_feature: GZ8MTXP02H86BA.11.71.G05.1.454.CMB.2.raw
  modified_base (279)..(279): a, c, t, g, unknown or other
  modified_base (306)..(306): a, c, t, g, unknown or other
  modified_base (337)..(337): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggacgtccctgagactctcctgtacagtcctctggccttcaccttnacttactatggcatgcacgtggtcccncagacctccgaggcgaggggctggagtgggngctagtttattcatatagattaggaaaattggtgtactttcgtaatttcgaacgtacctcccgggtagaaacgggtccctaacttccgacccgttaccaccgaaggaactaaccgtaactttacccgaacgggaccacccgaaccgtcgttacggttaaaccttacgttacgaaacctaaaagtaccggtaaaacccgaaggcccgttaggaaacggacgacgtaaccgggaaggaaccggtacggtccgttagttaggttaacttacgtacggtacgaaacgtaaaagttactttaacgtaagttaaggtagggtacggtacggttaaccggggg

SEQ ID NO: 410207 - DNA, 584 bp, Homo sapiens
  misc_feature: GZ8MTXP02GFJGU.11.71.G05.1.454.CMB.2.raw
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctctttaagaggtgtccagtgtcaggtgcaactggaggagtcgtgggggagcgtggtccagccgtgggacgtccctgagactctcctgtacagcctctggcttcaccttcattacctatggcatcgcactgggtcccgcagactccgaggcgagggggctgggagtggggtggctagtttattcatatgatggaaaatgtagacttctattcagtacctccgtagaaacgggccgtatccaccgtctccagagacacttccgagccacacgtcctgtatcctagactaaaatcgaaacagccgtagagacgcgtaggaacggaccgaacggcttacggttagttaacgtttacgtacggttgaaccggtaaaagttattttacgtaaagttacggagggttacggtaacggttaccggggg

SEQ ID NO: 410208 - DNA, 610 bp, Homo sapiens
  misc_feature: GZ8MTXP02F40AX.11.71.G05.1.454.CMB.2.raw
  modified_base (292)..(292): a, c, t, g, unknown or other
  modified_base (356)..(356): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggaggtccctgagactctcctgtacagcctctggcttcaccttcattacctatggcatgcacgtgggtccnccagacctccgaggcgagggggctgggaggtgggtgctagtttattcatatgataggaaatgtnacttctattcagtaccttccggtagaacggggtcctattcccgacccgttctacccgaagaacgaactaacttacccgaggaccaacgaccgtacctagttactccgtagaactaaaagtacgaaacacgacccgtaggaggacgacgtaggaacggacgacggtcttaggttagttaacgttacgtgtaggaacgtaaagttactttaagtaaagtaggtagggtaggtaaccggttacgggggtctttacgg

SEQ ID NO: 410209 - DNA, 659 bp, Homo sapiens
  misc_feature: GZ8MTXP02HBXYG.11.71.G05.1.454.CMB.2.raw
  modified_base (249)..(249): a, c, t, g, unknown or other
  modified_base (296)..(296): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggaggagtcgtggggggaggcgtggtccagccgtgggaggtccctgagactctcctgtacngcctctggccttcaccttcattacctatggcatgcacgtgggtcccnccagcctccgaggcgagggggctgggaggtggggtcgctaggtttatttcaatataggatagggaaaattggtatacttctaatttcgaacgtacgtccgtaggaacggggtccctaatttcccgacccgttctacccgtaagacgtaacaacgttaccgaacggaccaaccgtacggtacctagttaacgttaccgtacgactaaaacgtcgaaaccgtacgacccgtagaaggacgacgttaggaacggaacgacgggtactaggttacgttaacgtttaacgtgtacggtaaacgtaaacgttagtttaacgtaaggttaacggtagggttacgtaaccgggttacgggggtactttcgg

SEQ ID NO: 410210 - DNA, 563 bp, Homo sapiens
  misc_feature: GZ8MTXP02IZUVP.11.71.G05.1.454.CMB.2.raw
  modified_base (302)..(302): a, c, t, g, unknown or other
  modified_base (463)..(463): a, c, t, g, unknown or other
  modified_base (473)..(473): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggagcgtgtccagccgtgggaggtccctgagactctcctgtacagcctctggcttcaccttcattacctatggcatgcacgtgggtccnccagactccgaggcgaggggctgggagtgggtgctagtttattcatatgataggaaattgtgtacttctattcacgtacctccggtaggaaacgggtcccgtattccacccgtctccgagagactacttcagacacagctgtatctagactaatacgaacngcctagacgngacgtagacggactacggacttgtagttacttacgtagtcgaacgtaaagttactttactaagtaggtaggtacggtacggttacggggg

SEQ ID NO: 410211 - DNA, 746 bp, Homo sapiens
  misc_feature: GZ8MTXP02HRPVZ.11.71.G05.1.454.CMB.2.raw
  modified_base (168)..(168): a, c, t, g, unknown or other
  modified_base (177)..(177): a, c, t, g, unknown or other
  modified_base (184)..(184): a, c, t, g, unknown or other
  modified_base (188)..(188): a, c, t, g, unknown or other
  modified_base (273)..(273): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatgggagtttgggctgagtcttgggttttccncgttgcttntttaagnggtntccagtgtcaggtgacaacgtggaggtagtcgtgggggagcgtggtccagccgtggggacgtcctggagtactctccgtgtaacncgtccctgtggtccttacaaccgttcaacttaccgagtggacctagttcgaccgttaccgtcgggtccccaccgtaacggacctccgggaagggtcccgggaagggggtcctaggggtacgggttggggtacgtacgtttaaggttttacttacgaagttagttaggaaacggttaaggggtaaactttggtacggttacctttacgtaacttacgacgttaaacccgtccggtaaaggaaacggtcctaacgtttacccgaacccggtttcacccgaaaggaactaaacccgttagtccccgaaaggacccaaaccggtcgttacctaggttaaccttccgtaaggaaaccttaaagaccgttaaacgacgttacccgagtaacgaccgtagacggacggtaacgtccggtgttaaatcggttaatttaaccgggagtaaacgtaacgtaaatttcgttaacgtaagtacgg

SEQ ID NO: 410212 - DNA, 585 bp, Homo sapiens
  misc_feature: GZ8MTXP02IC4YA.11.71.G05.1.454.CMB.2.raw
  modified_base (247)..(247): a, c, t, g, unknown or other
  modified_base (254)..(254): a, c, t, g, unknown or other
  modified_base (293)..(293): a, c, t, g, unknown or other
  modified_base (537)..(537): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcggtgggggagcgtggtccagccgtgggagtccctgagactctcctgtacncgtcctntgcttcaccttcattaccatgcagtgcaccgtggtcccnccagacctccggaggccggaggggtctgggtagggtgggtacgacttaggtttacttcaattataggaaccgttagggaaaattggttacgtactttcattcgataccgtccggtaggacggcctaatccaaccgtctacagtaacactaactacgacggaccacgaccgtactagttatccgagtaacaagtacgacagtccgagacgagcgaggacgagacgtgtgttatacgtctacgganaacggtaatctaagtaagtaggtaggtcgtacggtacggtcgtttacg

SEQ ID NO: 410213 - DNA, 640 bp, Homo sapiens
  misc_feature: GZ8MTXP02F6PBZ.11.71.G05.1.454.CMB.2.raw
  modified_base (264)..(264): a, c, t, g, unknown or other
  modified_base (315)..(315): a, c, t, g, unknown or other
  modified_base (339)..(339): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggtcttcctcgttgctcttttaagaggtgtccagtgtcaggtgcaacgtggaggagtcgtgggggaggcgtggtccagccgtgggacgtccctgagactctctgtacngcctctggccttcaccttcattacctatcggcatcgctacgtcgggtcccnccagcctccgagggcgagggggcnggggagtggggtgcctagtttatttcattagtgtagtagggtaaattggtagtactttctattcaagtacgtccgtaggaacgggtcctacttccgacccgtcctaccgaaggacgtaactaacgttacccgaacggtaccaccgtacgccttagtactccgttaggaactaaacgtacgaaaccgacgtaccgtaggaacggtacgcgtaacggggaacggaaccgacgggtaccgttaggttagttaacgtttaccggttaggtacggtaacgtaaaagtttacgtttaacgttaaagg

SEQ ID NO: 410214 - DNA, 556 bp, Homo sapiens
  misc_feature: GZ8MTXP02JDJEW.11.71.G05.1.454.CMB.2.raw
  modified_base (148)..(148): a, c, t, g, unknown or other
  modified_base (405)..(405): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttccncgttgctcttttaagaggtgtccagtgtcaggtgcaactgggaggagtctgggggagcggtggtccagcctgggaggtccctgagactctcctgtacagctctggcttcaccttcattacctatggcatgcactgggtccgccagactccgaggcgagggggctggaggtgggtgggcagtttatttcatatgatggaaatcgtgtacttctatcagactccgtagaagggcgattccacgtctccagagacaatcncggacacacgctagtactctgactaaatacggaacaagcctgaagagcgtagaggacgacggtcgtgttaggtaattaccgtggtacgaacggtaaattaagttcgtaattaacggggacgtaggtaacgttaacggggggtacttttcgg

SEQ ID NO: 410215 - DNA, 503 bp, Homo sapiens
  misc_feature: GZ8MTXP02HLTHT.11.71.G05.1.454.CMB.2.raw
  modified_base (268)..(268): a, c, t, g, unknown or other
  modified_base (308)..(308): a, c, t, g, unknown or other
  modified_base (364)..(364): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctggggaggtccctgagactctcctgtacagcctntggcttcaccttcattacctatggcatgcactgggtcccnccagacctccaggcagggggctggagtgggtgcagttattcatatgatggaatgtnacttcattcagactcgtgaggcgatcaccgtctcagagacaattccaggcacacgctgtatctgacaaatagaacagaccagagacgatgaggacgacggcgtcgtgtataactgtagacgaaagtactacttataagg

SEQ ID NO: 410216 - DNA, 532 bp, Homo sapiens
  misc_feature: GZ8MTXP02F1CG1.11.71.G05.1.454.CMB.2.raw
  modified_base (306)..(306): a, c, t, g, unknown or other
  modified_base (361)..(361): a, c, t, g, unknown or other
  modified_base (402)..(402): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtcctgagactctcctgtacagcctctggcttcaccttcattacctatggcatgcacgtcgggtccncagactccgaggcgaggggctggagtgggtgcagttattcatatgatggaatgtntacttcgtattcagtactcgtagaacggccgattcacgtcncagagacatcaggcacgacgctagtactctagactaaatcgaaacagaccgtagacgagtacgtaggacggacgacggtctacgtgttaattaacgtggtagacggtaaagtactttacgagttaacggg

SEQ ID NO: 410217 - DNA, 652 bp, Homo sapiens
  misc_feature: GZ8MTXP02H9TPL.11.71.G05.1.454.CMB.2.raw
  modified_base (267)..(267): a, c, t, g, unknown or other
  modified_base (305)..(305): a, c, t, g, unknown or other
  modified_base (337)..(337): a, c, t, g, unknown or other
  modified_base (365)..(365): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtctgggggagcgtggtccagcctgggaggtccctgagactctctgtacagcctcnggccttcaccttcattacctatgcatgcacgtggtccnccagctccgaggcgaggggctgggagtggggngctagttattcatatgatagggaatgtnactttctattcgaatactcccgtagaacgggtcccgtattccgtacccgtacctccgaacgaagaacctaacttccgaaacgggcccaaccgtaccggtacttacggttaactccgttacgaacctaaaattcgaaaaccgttaacggcccgttaaggaaccggaacggtaccgttagggaaaccggtaaccggaaaccgggtccgtttacggttacgtttaagttaaccggttcggtaggtaaaccgtaaaacggttactttttaaccgttaaaggttaaacgggg

SEQ ID NO: 410218 - DNA, 563 bp, Homo sapiens
  misc_feature: GZ8MTXP02GYGSF.11.71.G05.1.454.CMB.2.raw
  modified_base (310)..(310): a, c, t, g, unknown or other
  modified_base (340)..(340): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggacgtccctgagactctcctgtacagcctctggcttcaccttcattacctatggcatgcacgtggtccncagactccgaggcgaggggctggagtgggngctagtttattcatagtgataggaatgtagtacttctattcaagtactccgtagaacggtccgtattccaacccgtctacccgagaacgactaaacttccgaaggaccacgacgtcctagttactcgtagaacaaagtagaaacacgacctaggagacgcgtagacggaacgacggtcgtcgtagttataacgtgtacgacgtaaagtatttactaagtaagg

SEQ ID NO: 410219 - DNA, 569 bp, Homo sapiens
  misc_feature: GZ8MTXP02I9HT7.11.71.G05.1.454.CMB.2.raw
  modified_base (267)..(267): a, c, t, g, unknown or other
  modified_base (309)..(309): a, c, t, g, unknown or other
  modified_base (338)..(338): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggagcgtggtccagccgtgggagtccctgagctctcctgtacagcctntggcttcaccttcattacctagtggcatgcacgtcgggtccncagctccgaggcgaggggctggagtgggngctagttattcatatgatagaatgtagtacttcgtatcgaagtctccgtagaacggccgtacttccaccgtctaccagacgaacaacttccaggtccaacgaccgctagtactcctagtaaccaaagtacgaaacgacgccgtaggagacgacgtacgggacggactacgggcttagtacgttaacgttcgtagtacggaacgtaaagttactttaactaagtttaacggg

SEQ ID NO: 410220 - DNA, 558 bp, Homo sapiens
  misc_feature: GZ8MTXP02GT2X0.11.71.G05.1.454.CMB.2.raw
  modified_base (308)..(308): a, c, t, g, unknown or other
  modified_base (474)..(474): a, c, t, g, unknown or other
  modified_base (492)..(492): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggacggtccctggagactctcctgtacagcctctggcttcaccttcattacctatcggcatgcacgtggggtcccnccagactccgaggcgagggggctgggaggtgggtggctagtttattcatatgattggaaaatgtgacttctattcagtacctcggtagaacgggcctattcaccgtctaccagagacaacttcaggcacgacgctagtactctgacaaatcgaaacagcctagagngactaggacgacacggtntacgtgtacttacgtagtagacgtaaagttactttactagtaggtaggtacgtacggttacggggg

SEQ ID NO: 410221 - DNA, 604 bp, Homo sapiens
  misc_feature: GZ8MTXP02JMU4P.11.71.G05.1.454.CMB.2.raw
  modified_base (308)..(308): a, c, t, g, unknown or other
  modified_base (340)..(340): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccaggcctggggagtccctgagactctcctgtacagcctctgcttcaccttcattacctatggcatgcacgtcggtccncagacctccgaggcgaggggctgggagtgggngctagttattcatatgataggaactgtagtacttactattcaagtaccgtaccgtaggaaacggggtcccgtaattacccgaacccgttcctacccgaagtaacgaacctaaacgttcccgaaggccaacgaccggtctaggtactacgtagaacctaaaagtagaaacacgaccgtagagaacgctagggaacggaccgacggtcgtacggttagttaagttaacgtaggtagaacggtaaaagttctttacgaagttaaggg

SEQ ID NO: 410222 - DNA, 550 bp, Homo sapiens
  misc_feature: GZ8MTXP02H64TK.11.71.G05.1.454.CMB.2.raw
  modified_base (267)..(267): a, c, t, g, unknown or other
  modified_base (272)..(272): a, c, t, g, unknown or other
  modified_base (307)..(307): a, c, t, g, unknown or other
  modified_base (333)..(333): a, c, t, g, unknown or other
  modified_base (370)..(370): a, c, t, g, unknown or other
  modified_base (377)..(377): a, c, t, g, unknown or other
  modified_base (438)..(438): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggaggagtcgtgggggaggcgtggtccagccgtggggacggtccctgagactctcctgtacngcctntgcttcaccttcatacctatgcatgcacgtggccnccagcctccgaggcgaggggctgggngtggggtgctagttattcgatatgattaggaattgtntactttnattcaagtccgtccgtagacggcgtatccgacgtctaccgagacgactagtccagacaacncgtctagtactctagaactaagtacaacgaacgcgtagacgagtcgaggacgacgaccggtagtcgtagttagttaacgtcggtagtacgtaagtatttacgtaaagtaggg

SEQ ID NO: 410223 - DNA, 688 bp, Homo sapiens
  misc_feature: GZ8MTXP02HRMT4.11.71.G05.1.454.CMB.2.raw
  modified_base (270)..(270): a, c, t, g, unknown or other
  modified_base (283)..(283): a, c, t, g, unknown or other
  modified_base (311)..(311): a, c, t, g, unknown or other
  modified_base (344)..(344): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagccgtgggagtccctgagactctctgtacagccctntgcttcacccttnattacctatggcatgcacgtgggtcccnccagctccgaggcgagggggctgggaggtgggnggactaggttatttcagttatgaatagggaattagtgtaactttctaagttcaaagtacccttacccggtaggaaacggggtcccgtaaacgtttcccgaaccccggttaccttaccccgaaagtaaccgaaacctaaagtttaccccgaaacgggtcccaaaccgtaaccgtccgttaggtaacttcccgtagaacctaaaagtacggaaaacacggcccttaggaacgtacggaccgttaggaacggaccgtaacggggtccttacggttacgttaaagttaacccgtacggttaacggtaacgtaaaaaggtttacttttaccggtaaaagttaaacgggg

SEQ ID NO: 410224 - DNA, 547 bp, Homo sapiens
  misc_feature: GZ8MTXP02JL636.11.71.G05.1.454.CMB.2.raw
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattaccctatggcatgcactgggtccnccagactccaggccgagggggctgggaggtggggtgggctaggttatttcatagtgatggaaatgtgtacttctattcagtactcgtgaagggcattcacctctcagacacatcgagcacacgactgtactcgtagactaaatagaacagtcctagacgagctaggacggacacgggtctggtattacgttacgtagtacgacgtaaagtacttaagtataacggtgggtacgacggttacgggggtactttacgg

SEQ ID NO: 410225 - DNA, 564 bp, Homo sapiens
  misc_feature: GZ8MTXP02HT3T4.11.71.G05.1.454.CMB.2.raw
  modified_base (296)..(296): a, c, t, g, unknown or other
  modified_base (332)..(332): a, c, t, g, unknown or other
  modified_base (371)..(371): a, c, t, g, unknown or other
  modified_base (540)..(540): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggaggtccctgagactctcctgtacagcctctggccttcaccttcattaccctatcggcatgcacgtcgggtccnccagacctccgaggcgagggggctgggaggtggggngcgtagttattcaatatgagtaggtaatgtagtactttntattcgagtacgtccgtaggtaacgggctatttcccgaccgtctaccagacaacacttcacggcacgacgtctgtactcgtgaacaaagtagaacacgtcgagaacgagacgtggaacgacaacggtctagttgttaactgtagtcgaacgtaattattaacgtatagnggtagcggttacggggtcttacgg

SEQ ID NO: 410226 - DNA, 567 bp, Homo sapiens
  misc_feature: GZ8MTXP02I0JAM.11.71.G05.1.454.CMB.2.raw
  modified_base (246)..(246): a, c, t, g, unknown or other
  modified_base (251)..(251): a, c, t, g, unknown or other
  modified_base (293)..(293): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacngcctntggcttcaccttcattaccctatggcatgcacgtgggtcccnccagcctccgaggcgaggggctgggagtgggtgctagttattcatatgataggaaatgtgtacttctatcagtactcgtagagggccattccacgtctcagagacattcaggcacgacgctgtatctagactaaagtacgaactacgacctagacgagtacgtaggaacggacgacggtctaggttacggttaacttacgtacggtagtaacgtaaagtactttaacgtaagtaacggtacggtacgtaaccgggttacgggggtctttaacgg

SEQ ID NO: 410227 - DNA, 586 bp, Homo sapiens
  misc_feature: GZ8MTXP02HFQ2W.11.71.G05.1.454.CMB.2.raw
  modified_base (245)..(245): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggagtccctgagactctctgtacngcctctggcttcaccttcattacctatggcatgcacgtcgggtcccgccagacctccgaggcgagggggctgggaggtggggtgctagtttattcatatgagtagaaatgtgtacttctattcgagtactccgtagaacgggtccgtattccgaccgtctacccgaagacgactaacgttccaggacacgacgtctagtatctagactaaatcgaacgacgccgtagagagcgtaggacggacgacggtctggttagttacgttacgtagtacggtaacgtaaaagttacgtttaacgtaagtacggtagggttagaccggggttacgggggtctttacgg

SEQ ID NO: 410228 - DNA, 983 bp, Homo sapiens
  misc_feature: GZ8MTXP02HOJNS.11.71.G05.1.454.CMB.2.raw
  modified_base (274)..(274): a, c, t, g, unknown or other
  modified_base (338)..(338): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttacttttaagaggtgtccagtgtcaggtgcaacgtggaggagtcggtgggggagcggtggtccaggccgtggggacggtccctggacgactctcctgtacngcctcgtcgccttcaccttcattaccctagtcggacattcggcctacggttcggggtacccccnccgtaacggacccgtaccccggaggggaccgggacggggggggtccttagggggtaagggttggggggtacgggtaccgtttaacgggtttttaactttaccgtaagtttaagttagggtaaacggtttaaaggggtaaactttaggggtttaacggttaaacctttttaccctttaagtttaccccggaaaaggtttacccccgttacccgggggtttaaacgggggaaacccgggggtttaccccggttaaacctttttacccccggtaacccccggtttacccgttaccccgggtaaaacggaaacccgggtaaaacccttaaacccgtttaaccccgggaaaccggggacccctaaaccgggtaacccggttaccgtttacgggttaaactttacccggttaacggaaaacctaaaaacggttccgggtaaaacccgaaaccgggttcccgtaaaagggggtaaaacgggaccgggtttaccgggtaaacgggggaaaacccggggttacccggtaaccggggtttaccgggttaggtttttaaccggtttaaacgtttaacccggttagggggttaaaccgggtaaaacggttaaaaccggtttaacgtttttaacggttaaaaggtttaaaccgggggg

SEQ ID NO: 410229 - DNA, 595 bp, Homo sapiens
  misc_feature: GZ8MTXP02HF89N.11.71.G05.1.454.CMB.2.raw
  modified_base (245)..(245): a, c, t, g, unknown or other
  modified_base (289)..(289): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagcctgggagtccctgagactctcctgtacngcctctggcttcaccttcattacctatggcatgcacgtgggccnccagacctccgagggcgagggggctgggaggtggggtggctagtttattcatagtgagtaggaaatgtgtacttctattcagtactccggagaacgggcctattcccaccgtctaccagacgactaacgttccacggcacacgtctagtatctagactaaatacgaactacgccgtagacgagacgtaggaacgacgacggtcgtaggttagttaacgttacgtagtacggaacgtaaaagttacgtttaacgtaaagttagggtaacgggttacggtaaccgggttacgggggtacgttttacgg

SEQ ID NO: 410230 - DNA, 567 bp, Homo sapiens
  misc_feature: GZ8MTXP02GY09X.11.71.G05.1.454.CMB.2.raw
  modified_base (291)..(291): a, c, t, g, unknown or other
  modified_base (362)..(362): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcacgtgggtccnccagacctccgaggcgagggggctgggaggtgggtggctaggtttattcatatgataggaaatgtgacttntattcagtactccggtagaacgggcctattccaccgtctaccagacgacaacttccaggcacacgctagtatctagactaaatcgaaacacgcctagacgagcgtaggacggacgacggtctagtgttacttacgtagtacggtaacgaaagttatttaacgtaagtaacggtagggtacggtaccggtacgggggtctttacgg

SEQ ID NO: 410231 - DNA, 559 bp, Homo sapiens
  misc_feature: GZ8MTXP02FVH8W.11.71.G05.1.454.CMB.2.raw
  modified_base (292)..(292): a, c, t, g, unknown or other
  modified_base (355)..(355): a, c, t, g, unknown or other
  modified_base (361)..(361): a, c, t, g, unknown or other
  modified_base (367)..(367): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctggggaggtccctgagactctcctgtacagcctctggcttcaccttcattacctatggcatgcacgtgggtccnccagactccgaggcgaggggctggagtgggtgctagttattcatatgatggaaatgtgacttnattcanctccgngaaggcattcaccgtctcagagacatcagcacacgctgtatctagactaaatcggaaacacgaccgtagagtacgacgtaggaacggaccgacggtacgttagttggttaacttacgtagttacggaacgtaaaagtactttaacgtaagtaacggtagggtacgtaaccgggtacgggggtcgtttaccgg

SEQ ID NO: 410232 - DNA, 569 bp, Homo sapiens
  misc_feature: GZ8MTXP02H20D3.11.71.G05.1.454.CMB.2.raw
  modified_base (182)..(182): a, c, t, g, unknown or other
  modified_base (346)..(346): a, c, t, g, unknown or other
  modified_base (378)..(378): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagnggtgtccagtgtcaggtgcaactggaggagtcgtgggggaggcgtggtccagcctggggagtccctgagacctctcctgtacagcctctggcttcaccttcattacctatggcatgcacgtgggtcccgccagacctccgaggcgagggggctgggagtggggnggcagtttattcatagtgatagatgtgacttntatcagtaccgtcgagaacggccgtatccgaccgttctacccgagtacgaactacttccgaaggtccaacacggtctagtactctagaccaaatacggaaacagaccgtagagacgacgtcggacggaacgacggtacgtagttacgtatttaacgtgtaggacgtaaagtacctttagtaacgttaaggg

SEQ ID NO: 410233 - DNA, 528 bp, Homo sapiens
  misc_feature: GZ8MTXP02F5HB4.11.71.G05.1.454.CMB.2.raw
  modified_base (306)..(306): a, c, t, g, unknown or other
  modified_base (335)..(335): a, c, t, g, unknown or other
  modified_base (359)..(359): a, c, t, g, unknown or other
  modified_base (445)..(445): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggagcgtggtccagcctgggagtccctgagactctcctgtacagcctctggcttcaccttcattaccctatggcatgcactgggtcccncagactccaggcagggggctggagtgggngcagttattcatatgatggaatgngtacttctattcagtactccgtgaacgggcattcaccgtctccagacgacattccaggcacacgctgtatcctgactaaatgaacngaccctagagaacgctaggacggacacggctacggtgttaacttaacgtaggtacgtacgtaaagtactttacgagttaaggg

SEQ ID NO: 410234 - DNA, 636 bp, Homo sapiens
  misc_feature: GZ8MTXP02HU8HB.11.71.G05.1.454.CMB.2.raw
  modified_base (291)..(291): a, c, t, g, unknown or other
  modified_base (361)..(361): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattaccctatggcatgcactgggtccnccagacctccgaggcgagggggctgggaggtggggtgctagttattcatatgataggaaatgtgtacttntattcagtactccggtagaacggtccgaatttccaacccgtctaccaagacgaactaattcccgaaggccaaccgaccgtctaggtatcctagactaaaagtacgaaacgtacgaccgttaggaacgacgtaccgtaggaacgggtaaccgaacgggtcgttaggttagttaaactttaccgtaggttacgaaccgtaaaaagttacgttttaacgtaaaggttaacgggtaggggttacggtaaccggttaacgggggggttccttttaccggg

SEQ ID NO: 410235 - DNA, 567 bp, Homo sapiens
  misc_feature: GZ8MTXP02IS90U.11.71.G05.1.454.CMB.2.raw
  modified_base (289)..(289): a, c, t, g, unknown or other
tcagcgagagataccacgaccggtgctcgatttagtgtcgtcgcaagagagaggagcccagcactagaagtcggcggtgtttccattcggtgatcagcaatgaacacagaggactcaccatggagtttgggctgagctgggttttcctcgttgctcttttaagaggtgtccagtgtcaggtgcaactggaggagtcgtgggggaggcgtggtccagcctgggagtccctgagactctcctgtacagcctctggcttcaccttcattacctatggcatgcactgggcccnccagactccgaggcgagggggctgggaggtgggtggctagttatttcatatgataggaaattgtgacttctattcagtacctccggtagaacggggccatttccaccgtctaccagacgacaattccagcacacgctagtatctgacaaatacgaacacgcctagagagactggaacggacgacggtctagttaggttaactttacgtacggtagtaaccgtaaaagttatttaacgtagtaacggtacggtaggaccggttacgggggtctttacgg

SEQ ID NO: 410236 - DNA, 656 bp, Homo sapiens
  misc_feature: GZ8MTXP02GTCE3.11.71.G05.1.454.CMB.2.raw
  modified_base (264)..(264): a, c, t, g, unknown or other
  modified_base (282)..(282): a, c, t, g, unknown or other
  modified_base (309)..(309): a, c, t, g, unknown or other
  modified_base (316)..(316): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagcctggggacgtcctgagctctcctgtacngcctctggcttcaccttnattacctatggcatgcacgtgggtccnccagccnccaggcgagggggctgggagtggggtgctagtttattcatagtgattaggaatgtcgtatttctattcgagtaccgtccgtaggaaacgggccgtaactttcgacccgtttactccccgaagacggtaacctaaacgttacccgaaacgggaccaaccgtaaccgggtccttagggttaaactttccgtacggaaaccttaaaagtacggaaaaaccgtcggtaaccgtaggaacggtacggacgtaacgggaacggtaccggtacggtcgttacggttacgtttaacgttaacgtaggtaacggtaacgtaaaagttacgtttacgtaaggttaacggg

SEQ ID NO: 410237 - DNA, 568 bp, Homo sapiens
  misc_feature: GZ8MTXP02IDO2D.11.71.G05.1.454.CMB.2.raw
  modified_base (249)..(249): a, c, t, g, unknown or other
  modified_base (293)..(293): a, c, t, g, unknown or other
  modified_base (431)..(431): a, c, t, g, unknown or other
  modified_base (457)..(457): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagccgtgggaggtccctgagactctcctgtacngcctctggcttcacttcattaccatggcatgcacgtcgggtccnccagacctccgaggcgagggggctgggaggtggggtggctagttattcatagtgagtaggaaactgtagtactttctattcagtactccggtagaacgggtccatttcccaccgtcaccagagactaattcgagcacncgctgtactctagactaaatgaaacngacgtagagacgcgtagacggacgacggtcgtgttagttacttacgtgtacgaacgtaaagttatttaacgtaagtacggtacggtacggtacggttacggggttcgttcg

SEQ ID NO: 410238 - DNA, 587 bp, Homo sapiens
  misc_feature: GZ8MTXP02FYDJS.11.71.G05.1.454.CMB.2.raw
  modified_base (310)..(310): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggagtccctgagactctcctgtacagcctctggcttcaccttcattacctatggcatgcacgtcgggtcccnccagacctccgaggcgagggggctgggaggtggggtggctaggttatttcattagtagaagttagggaattgtgtactttctattcagtacctcgtagaacgggccgtacgttccgacccgtctacccgaagacgaactaaacttccgaacggccaacaccgtctagttacgttactagaccaaatacgaaacagccgtagacgacgacgtaggaacggtacgacggtctagtagttattaacgtgtacgacggtaaagtactttacgtaagtaagg

SEQ ID NO: 410239 - DNA, 542 bp, Homo sapiens
  misc_feature: GZ8MTXP02F9L2Z.11.71.G05.1.454.CMB.2.raw
  modified_base (304)..(304): a, c, t, g, unknown or other
  modified_base (341)..(341): a, c, t, g, unknown or other
  modified_base (452)..(452): a, c, t, g, unknown or other
  modified_base (524)..(524): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggagcgtggtccagcctgggagtccctgagactctcctgtacagcctctggcttcaccttcattacctatggcatgcactgggtccncagactccgaggcgaggggctggagtgggtgcagttnttcatatgatggaatgtgtacttctattcagtactccgtagaacggccgattccaccgtctaccagacgacattccaggccacacgtctgtatctagactaaatcgaaacngaccgtagaagacgcgtaggacggacgacggacttaggtagttacttaacgtacggtagtacggtaaaagtntttaacgtattaaacggg

SEQ ID NO: 410240 - DNA, 521 bp, Homo sapiens
  misc_feature: GZ8MTXP02I3I0Q.11.71.G05.1.454.CMB.2.raw
  modified_base (266)..(266): a, c, t, g, unknown or other
  modified_base (305)..(305): a, c, t, g, unknown or other
  modified_base (381)..(381): a, c, t, g, unknown or other
  modified_base (438)..(438): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagctctcctgtacagcctcnggcttcaccttcattacctatggcatgcacgtgggtccnccagactccaggcgaggggctggagtgggtggctagttattcatatgatggaatgtgtacttctattcagtctcgngaggcatcacgtctccagagacatcaggcacacgctgtatctagacaaatcgaaacncgacctgacgacgcgtaggacggacacggtctaggtagttacttaacgtggtacgacggtaaagtactttacgtaagttaagg

SEQ ID NO: 410241 - DNA, 575 bp, Homo sapiens
  misc_feature: GZ8MTXP02HIR1A.11.71.G05.1.454.CMB.2.raw
  modified_base (264)..(264): a, c, t, g, unknown or other
  modified_base (310)..(310): a, c, t, g, unknown or other
  modified_base (375)..(375): a, c, t, g, unknown or other
  modified_base (382)..(382): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggagcgtggtccagccgtgggagtccctgagactctcctgtacngcctctggcttcaccttcattacctatggcatgccagtcgggtccnccagcctcgaggcgaggggctgggagtggggtgctagtttattcattagtgagtagggaattgtntactttntattcagtacctccgtagaacggctactccacccgtctaccagacgaactactccgaggtaccacgacgtctgtactctacgaactaaagtacgaaacgacgaccgtagaacgtacgacgtagggaacgacgacggtcgtacgtagttaacttaacgtgtacgaacgtaaagttacgtttacgtaagtaacgg

SEQ ID NO: 410242 - DNA, 521 bp, Homo sapiens
  misc_feature: GZ8MTXP02J125L.11.71.G05.1.454.CMB.2.raw
  modified_base (347)..(347): a, c, t, g, unknown or other
  modified_base (374)..(374): a, c, t, g, unknown or other
  modified_base (409)..(409): a, c, t, g, unknown or other
  modified_base (414)..(414): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccaggcctggggaggtccctggagactctcctgtacagcctctggcttcaccttcattaccatggcatgcacgtgggtcccgccagacctccgaggcgagggggctgggagtggggngctagttattcatatgataggaatgtntacttcattcagactcgtagaggccattcacgtcncaganacaatccaggcacacgctgtatcagactaaagagaacacgaccagagacgacgagaggacgacgctacgtgtattaagtagtacgacgtaaagtacttactataagg

SEQ ID NO: 410243 - DNA, 593 bp, Homo sapiens
  misc_feature: GZ8MTXP02JNZZO.11.71.G05.1.454.CMB.2.raw
  modified_base (244)..(244): a, c, t, g, unknown or other
  modified_base (250)..(250): a, c, t, g, unknown or other
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacngcctcnggtcttcaccttcattacctatggcatgcacgtcgggtccnccagactccgaggcgagggggctgggagtgggtggctagttattcatagtgataggaaatgtgtacttcattcagtactccggtagaacgggcctattccgaccgtctccagagacaatccagcacacgctgtactctagacaaatcgaaaccgacgaccgtgaacggacgcgtaggaacgggaccgaacggtcgttaggttacgttaagttaccgttcggttagaaccggtaaaagttacgtttaacgtaaaggtaacggtagggttacggaacgggtttaaccgggggtcgttttaccgg

SEQ ID NO: 410244 - DNA, 619 bp, Homo sapiens
  misc_feature: GZ8MTXP02FSZOO.11.71.G05.1.454.CMB.2.raw
  modified_base (246)..(246): a, c, t, g, unknown or other
  modified_base (251)..(251): a, c, t, g, unknown or other
  modified_base (288)..(288): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggaggtcctgagactctcctgtacngcctntgctcacttcattacctatggcatgcacgtgggtccncagcctcgaggcgagggggctgggaggtggggtgctagtttattcatagtgaagtaggaaatagtgtactttctattcagtactcggtagaacgggtcctattcccaccgtctaccagacgacaatccacggcacacgtctgtatctagactaaagtacgaaacacgaccgtgaacgacgtacgtagggaacggaccgaccgggtacgttacggttagttaacgtttaacggttaggttaacggtaacggtaaaacgttaagtttaacgtaaacggttaacgggtaacgggttacgggtaaccggggttaccgggggttacgtttaccggg

SEQ ID NO: 410245 - DNA, 637 bp, Homo sapiens
  misc_feature: GZ8MTXP02IFFVF.11.71.G05.1.454.CMB.2.raw
  modified_base (268)..(268): a, c, t, g, unknown or other
  modified_base (314)..(314): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggtttttcctcgttgcttcttttaagaggtgtccagtgtcaggtgacaacgtggaggagtcgtgggggaggcgtggtccagccgtgggacgtccctgagactctctgtacngcctctggcttcaccttcacttacctatggcatgcacgtcggtccnccacgctcgaggcggaggggctgggaggtggggtcggctacgtttattacagtatagagtaaggtatagttagtacttactattcgaataccgtacgtaggaacggaccgtacttccgtacccgtctaccgagaacgaactaacgttccgacggacccacgaccgtctacgttactacgttagaacctaaatacgaaacgacgtaccctaggaacgacgtacgtacgggaacggtaacggaaccgggtcgttacggttagttaacgttaacgttggtacggtaaccgtaaaaggtttacgtttaacgttaaggttaaacgggg

SEQ ID NO: 410246 - DNA, 599 bp, Homo sapiens
  misc_feature: GZ8MTXP02JUG53.11.71.G05.1.454.CMB.2.raw
  modified_base (313)..(313): a, c, t, g, unknown or other
  modified_base (359)..(359): a, c, t, g, unknown or other
  modified_base (382)..(382): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggaggcggtggtccagccgtgggaggtccctgagactctcctgtacagcctctggccttcaccttcattacctatggcatgcacgtgggtcccncagacctccgaggcgaggggctgggagtggggtgctaggttacttnatatgagtaggaatgtgtacttntattcgagtaccgtacgtgaacgggccgtattcccgaaccgtctcccagacgaactacttccgaggccaacgacgtctagttactcgtagactaaacgtcgaaacacgtccgtaggagtacgacgtacggaacgggaccgtaacgggtccgttaggttacgttaagttaaccgtggtaaccggtacgtaaaaggttactttacgtaacgtaaagggg

SEQ ID NO: 410247 - DNA, 674 bp, Homo sapiens
  misc_feature: GZ8MTXP02H8J6J.11.71.G05.1.454.CMB.2.raw
  modified_base (246)..(246): a, c, t, g, unknown or other
  modified_base (292)..(292): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacngcctctggcttcaccttcattacctatggcatgcacgtgggtcccnccagacctccgaggcgagggggctgggagtggggtgctagttattcatatgataggaaaattggtgtactttctaattcagtacctccggtagaacggggtccctaattcccacccgtctacccgagacgaaccaaacgttacccgacgggtaccaaccgaaccgtccgttaggttaaacttcgttacggaacctaaaagttacggaaaaccgtacgacccgtaggaacggaggaaccgttagggaaacgggaaccgtaacccgggtcgttagggttacggttaactttaaccgtaggttacggaaccggttaaaagttaagttttaacgtaagttaacggtagggttacggtaaccgggttacgggggtaccgtttaccgg

SEQ ID NO: 410248 - DNA, 542 bp, Homo sapiens
  misc_feature: GZ8MTXP02GGZ72.11.71.G05.1.454.CMB.2.raw
  modified_base (307)..(307): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacagcctctggcttcaccttcattacctatggcatgcacgtgggtcccnccagacctccgaggcgagggggctgggagtggggtggctagtttattcatatgatggaatgtgacttctattcagacctccgtgaacggcctattccaccgtctccagacgacacttccgagcacacgctgtactctagactaaatcgaacagcctagagacgacgtaggaacggacgacggtctggtacgttagttaacgtgtagacgtaaagtagtttacgtaagttaacggg

SEQ ID NO: 410249 - DNA, 561 bp, Homo sapiens
  misc_feature: GZ8MTXP02HQWIC.11.71.G05.1.454.CMB.2.raw
  modified_base (268)..(268): a, c, t, g, unknown or other
  modified_base (313)..(313): a, c, t, g, unknown or other
  modified_base (381)..(381): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggttgtccagtgtcaggtgcaactgggaggagtcgtgggggaggcgtggtccaggcctggggacgtccctgagactctcctgtacngcctctggcttcaccttcattacctatggcatgcacgtgggcccnccagacctccgaggcgagggggctgggagtggggtggctaggtttattcatagtgaatggaaattgtnactttctattcgatcctccgtgaagggccaattccaccgtctccgagacgacaacttccaaggccacaacgctagtactctgacaaatgaaacagcctagacgagcgtggaacgacgaccggtctggtagttaacttaacgtaggtacggaacgtaaaagtactttacgtaagtaagggg

SEQ ID NO: 410250 - DNA, 564 bp, Homo sapiens
  misc_feature: GZ8MTXP02HD37D.11.71.G05.1.454.CMB.2.raw
  modified_base (181)..(181): a, c, t, g, unknown or other
  modified_base (272)..(272): a, c, t, g, unknown or other
  modified_base (311)..(311): a, c, t, g, unknown or other
  modified_base (341)..(341): a, c, t, g, unknown or other
  modified_base (430)..(430): a, c, t, g, unknown or other
  modified_base (461)..(461): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcaactgggaggagtcgtgggggaggcgtggtccaggccgtggggaggtccctgagactctcctgtacagcctntggcttcaccttcattacctatggcatgcacgtgggccncagactccgaggcagggggctggagtgggngctagttatttcgatatgataggaatagtgtacttctaattcagtacgtaccgtgaaacggggctacgttcaaccgtcacccgaggaanacaaagttccaggaccacgacgctgtaactntagaacaaataagaacacgacgtacgagacgacgtagacggaacgacggtacgtacgtagttattaacgtacgtacgtacgtaaagtacttacgtaagtaagg

SEQ ID NO: 410251 - DNA, 558 bp, Homo sapiens
  misc_feature: GZ8MTXP02FTZ2S.11.71.G05.1.454.CMB.2.raw
  modified_base (251)..(251): a, c, t, g, unknown or other
  modified_base (293)..(293): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggaggtccctgagactctcctgtacagcctntggcttcaccttcattaccctatggcatgcacgtgggtcccnccagacctccgaggcgagggggctgggagtggggtggctaggtttatttcatatgataggaaatgtgactttctattcagtactccgtgaacgggcctattccaccgtctccagagacaatccaggcacgacgctgtatctgacaaatagaacagacctagagtagctaggacggacgacggctgtagttattacgtgtagaacgtaaagttatttaacgttaagtaggtacgggttacggtacgggttacgggggtcgtttacg

SEQ ID NO: 410252 - DNA, 609 bp, Homo sapiens
  misc_feature: GZ8MTXP02GUGDC.11.71.G05.1.454.CMB.2.raw
  modified_base (185)..(185): a, c, t, g, unknown or other
  modified_base (259)..(259): a, c, t, g, unknown or other
  modified_base (264)..(264): a, c, t, g, unknown or other
  modified_base (299)..(299): a, c, t, g, unknown or other
  modified_base (328)..(328): a, c, t, g, unknown or other
  modified_base (339)..(339): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtntccagtgtcaggtgcaactggaggagtctgggggagcgtgtccagcctgggagtccctgagactctcctgtacngcctnggcttcactcattacctatgcatgcactgggtccncagactccaggcagggggctggagtgggngcagttacttnatatgatagactgtagtacttactattcgaacgtaccctacgtaggaaacggtcctaacttccgaacccgttcctaccgaagaacgaactaacgttccgaacggaccaacgtacgtcgtagtactacgtacgtaacgtaaacgtaacgtaaacgtaacgtaccgtacgaacgaacgacgtacggaacggaacggaacggtacgtacgttacgttaacgttaacgttacgtacggtaacgtaaacgttaaacgtttaacgttaacgtaagg

SEQ ID NO: 410253 - DNA, 560 bp, Homo sapiens
  misc_feature: GZ8MTXP02J3IWJ.11.71.G05.1.454.CMB.2.raw
  modified_base (301)..(301): a, c, t, g, unknown or other
  modified_base (343)..(343): a, c, t, g, unknown or other
  modified_base (361)..(361): a, c, t, g, unknown or other
  modified_base (367)..(367): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcgtgggttttcctcgttgctcttttaagaggtgtccagtgtcaggtgcaactggaggagtcgtgggggaggcgtggtccagccgtgggaggtccctgagactctcctgtacagcctctggcttcaccttcattaccatggcatgcatgggtcccncagctcgaggcggaggggctgggaggtgggtgctagtttatnatagagagtaggaatgtntacttntatcagcgtcggtagacggcctactccaccgtctacgagacgactactaccgagaccacacgtctagtactctacgacaacgtacgaacgacgacgacgagagacgtacgacggacgacggcgtacgtagttacgtacgtacgtacgtaacgtaagtacttacgtacgtaggtacggtacggtacggtacggg

SEQ ID NO: 410254 - DNA, 640 bp, Homo sapiens
  misc_feature: GZ8MTXP02H20SV.11.71.G05.1.454.CMB.2.raw
  modified_base (343)..(343): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctcctgtacagcctctggccttcacccttcattaccatggcatgcacgtcgggtccgccagacctccgaggcgagggggctgggaggtggggtgctagttatttcatntgagtaggaaaattgtgtactttcgtattcgagtactccggtagaaacgggtcccgtaattcccgacccgttcctaccgaacgaacgtaacctaacgtttacccgaacgggcccaaccgaaccgtccgttacgtacttccgtacgaactaaaagtacgaaaccacgtacccgtaggaacgacggacgtacggaacggaccgacggtcgtaggttcgttaataccgttagtagtaacgtaaagttatttaacgtagtaaggtacggtacggtaccgggtacgggggttacgtttacgg

SEQ ID NO: 410255 - DNA, 653 bp, Homo sapiens
  misc_feature: GZ8MTXP02FXGXW.11.71.G05.1.454.CMB.2.raw
  modified_base (304)..(304): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggaggtccctgagactctcctgtacagcctctggcttcaccttcattacctatggcatgcacgtgggtcccnccagacctccaggcgaggggctggagtggggtgctagttattcatatgataggaaatgtagacttcgtattcagtacctccggtaggaagggtccgtattctacccttctaccagtacgaacacttccgaacggtcaaccgacgtaccttggtaacttccgttagacctaaaagttacgaaaacgacgacccgttaggaacggacgaccgttagggaaacgggaacccgtaacggggtccttacgggttacgtttaaagtttaccggttacggttaggtaaccggaaaagtttaagttttacgtaaaggttagggtaaggggttacggtaaccgggtttaaccgggggg

SEQ ID NO: 410256 - DNA, 584 bp, Homo sapiens
  misc_feature: GZ8MTXP02JZ90J.11.71.G05.1.454.CMB.2.raw
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcactcgggtccncagacctccgaggcgagggggctgggagtggggtgctaggtttattcatatgagtaggaaatgtgacttctattccagtactccggtagaacgggccctattccaccgtctaccagtacgaactaacttccgaggaccacgacgtctagtactcctagacaaatacgaaacgacgaccgtaggagacggtcgaggaacggacgaacgggtctaggtacgttaacgttacgtacgtagaacgtaagtagtttcgtaagtacggaggttacggacggttacgggggtctttacgg

SEQ ID NO: 410257 - DNA, 626 bp, Homo sapiens
  misc_feature: GZ8MTXP02IM7UA.11.71.G05.1.454.CMB.2.raw
  modified_base (267)..(267): a, c, t, g, unknown or other
  modified_base (315)..(315): a, c, t, g, unknown or other
  modified_base (426)..(426): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggtttttcctcgtttgcttctttttaagaggttgtccagtgtcaggtgcaacgtggaggagtcggtgggggagcgtggtccagccgtggggacgtccctgacgactctcctgtacngcctctgcttcaccttcattacctatggcatcgctacgtcgggtcccnccagacctccgaggccgaggggctggaggtgggtgctagtttattcgatagtagagtaggaaattgtgtacttctattcagtactaccggtagaacgggctatcaccgtcncagagactaactcgacgacacacgtctagtactcgtagaactaaagtacgaaactacgtaccctagaacggacgtacgtaagggaacggaccgtaacgggtcttaggttaacgttaatttaccgtacgttagtaaaccggtaaaattcgttttaacgtaagttaaggtacgggtttacggtaacgggtttaacccggggg

SEQ ID NO: 410258 - DNA, 596 bp, Homo sapiens
  misc_feature: GZ8MTXP02JYK6F.11.71.G05.1.454.CMB.2.raw
  modified_base (261)..(261): a, c, t, g, unknown or other
  modified_base (266)..(266): a, c, t, g, unknown or other
  modified_base (307)..(307): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggagtccctgagctctctgtacngcctntggcttcaccttcattacctatggcatgcacgtcgggtccnccagcctccgaggcgaggggctgggagtggggtggctagttattcaatagtgattaggaatgtagtactttcgtattcgaagccgtccgtaggaaacgggtccgtaacgttcccgacccgttctacccgaagaacgtactaacttccgagggccaacgacgtctagtactctagaacctaaagtacggaaacacgacctaggaacgacgacgagggaacggaccgacgggtacgtcggttagttaacttcgtaggtacgaacgtaaacgttatttacgaagttaacggg

SEQ ID NO: 410259 - DNA, 524 bp, Homo sapiens
  misc_feature: GZ8MTXP02FRYIK.11.71.G05.1.454.CMB.2.raw
  modified_base (304)..(304): a, c, t, g, unknown or other
  modified_base (448)..(448): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggagcgtggtccagcctgggagtccctgagactctcctgtacagcctctggcttcaccttcattacctatggcatgcactgggtccncagactccaggcaggggctggagtgggtgctagtttattcatatgatggaatgtgacttctattcagtactccgtgaacgggccattccaccgtctccagagacaaattccgaggccacgcgctgtactctgacaaatgaaacngcctagagacgctaggacggacgacggtctggtattaagtaacgtggtacgacgtaaagtctttacgtataaaggg

SEQ ID NO: 410260 - DNA, 595 bp, Homo sapiens
  misc_feature: GZ8MTXP02JY9BF.11.71.G05.1.454.CMB.2.raw
  modified_base (257)..(257): a, c, t, g, unknown or other
  modified_base (300)..(300): a, c, t, g, unknown or other
  modified_base (311)..(311): a, c, t, g, unknown or other
  modified_base (366)..(366): a, c, t, g, unknown or other
  modified_base (385)..(385): a, c, t, g, unknown or other
  modified_base (400)..(400): a, c, t, g, unknown or other
  modified_base (419)..(419): a, c, t, g, unknown or other
  modified_base (444)..(444): a, c, t, g, unknown or other
  modified_base (469)..(469): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggtttcctcgttgctcttttaagagtgtccagtgtcagtgcaaactgggaggagtctggggggagcgtggtccagccctggggagtccctgagacctctcctgtacngtcctcgttggccttcacctttcacttaacctatggcatcgcncgtgggtcccnccagcctccgagggcaggggtctgggaggtggggtggctaggtttattcattagngtatgaaaattgatctttntaattcagtactcgngagggccgtatcaccgtcncagacgacaacttcaggcacgacgntgtatctagacaaatgaacatccgngaacggagacgtagaaacgggacgacggtacgttaggtacgttaatttaaccgtgttcggaacgttaaaagtagtttttacctaagttaaggtagggttacgtaaccgggggtttaacccgggggg

SEQ ID NO: 410261 - DNA, 629 bp, Homo sapiens
  misc_feature: GZ8MTXP02JJ7AW.11.71.G05.1.454.CMB.2.raw
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggagtccctgagactctcctgtacagcctctggcttcaccttcattacctatggcatgcactcgggtccgccagacctccgaggcagggggctgggagtggggtggcagtttattcatatgataggaatgtgtacttctattcagtaccgtacccgtagaaacgggtccgtagttccgacccgttcctcccaaggtacgaacctaaacgttcccagggacccaaaccgaccggtccttaggtaactccttacggacctaaaagtcgaaaaccacggtaccctaggaacgacgaccgtagggacggaccggacggtacgttcggttagttaacgtttaaccgtaggtacggtaaacgggtaaaagtacgttttaacgtaggtttaaacgggg

SEQ ID NO: 410262 - DNA, 585 bp, Homo sapiens
  misc_feature: GZ8MTXP02JT6M5.11.71.G05.1.454.CMB.2.raw
  modified_base (245)..(245): a, c, t, g, unknown or other
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagcctgggagtccctgagactctcctgtacngcctctggcttcaccttcattacctatggcatgcacgtcgggtccnccagcctccgaggcgaggggctgggaggtgggtgctagttatttcatagtgagtaggaaattgtgtacttgattcagtactccggtagaacggggcctattccgaccgtctaccagacgactaattccagcacacgctgtatctagactaaatacgaaacgacgccgtagacggacgtcgtaggacggacgaccggtcgtaggttagttacgttacgtaggttacgacggtaaagttagtttaacgtagttaacggtacgggttacggtaaccggttacgggggtctttaccgg

SEQ ID NO: 410263 - DNA, 606 bp, Homo sapiens
  misc_feature: GZ8MTXP02GPR7Y.11.71.G05.1.454.CMB.2.raw
  modified_base (312)..(312): a, c, t, g, unknown or other
  modified_base (413)..(413): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggaggagtctgggggaggcgtggtccagccgtggggaggtccctgagactctcctgtacagcctctggcttcaccttcattacctatggcatgccacgtgggtcccnccagacctccgaggcgagggggctgggaggtggggtgctagtttattcatatgataggaatgtgacttctattcagtactcgtgaacggcattcaccgtcncctagacgactacttcgacggcacacgtctgttactcgtagactaaaagtcgaaaacccgtgaccgtaggaacggtacggtaccgttagggaaaccggaccggtaaccggggtccgttacggttaggttaacgttaaccgttggtacggtaaaccggtaaaacgttaggttttaaccttaaggttaaacgggg

SEQ ID NO: 410264 - DNA, 658 bp, Homo sapiens
  misc_feature: GZ8MTXP02H4M4A.11.71.G05.1.454.CMB.2.raw
  modified_base (274)..(274): a, c, t, g, unknown or other
  modified_base (317)..(317): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccaggccgtggggacggtccctgagactctcctgtacagcctntggccttcaccttcattacctatggcatgccacgtgggtcccncagcctcgaggcgaggggctgggaggtggggtggctaggttatttcgatagtgagtaggaattacggtgtactttactattcgaagtacctcccggtaggaacggggtacccgtacgtttacccgacccgttccgttacccgaacggtaacgaaccgttacgttacccgacgggaccaaccgacgtctaggtactcgtacgaacctaaagtacgaacacgaccgtaggaacgtacggaccgtagggaacgaccggacgggtaccgtacggttacggttaagttaaccggtagttaaccggtaacggtaaaacgtttacgtttaacgtttaagtaaacgggg

SEQ ID NO: 410265 - DNA, 607 bp, Homo sapiens
  misc_feature: GZ8MTXP02G2KHN.11.71.G05.1.454.CMB.2.raw
  modified_base (296)..(296): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagccgtgggagtccctgagctctctgtacagcctctgtcttcaccttcacttacctagtcgcatcgcacgtcgggtcccnccagcctccgaggcgaggggctgggaggtgggtgtctagttattcatatgataggaaatgtgtacttctattcgagtactccggtagaacgggtcctattcccgtaccgtcctccgaagtacgaactaacgttaccgacgaccaacgtacgtacgttacgtatcgttacgaactaaagtacgaaacgacgaccgtagacggacggtcgtacggacggaacgacggtacgtaggttacgttagttacgtcgtacgtaacgtaagttattaacgtagtacggtaggtacgtacggtaccggggtcgtttacgg

SEQ ID NO: 410266 - DNA, 544 bp, Homo sapiens
  misc_feature: GZ8MTXP02IT7WS.11.71.G05.1.454.CMB.2.raw
  modified_base (246)..(246): a, c, t, g, unknown or other
  modified_base (251)..(251): a, c, t, g, unknown or other
  modified_base (290)..(290): a, c, t, g, unknown or other
  modified_base (440)..(440): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagcctggggagtccctgagactctcctgtacngcctntggcttcaccttcattacctatgcatgcacgtgggtccnccagactccgaggcaggggctggagtgggtgctagtttattcatagtgatggaaatgtgactttctattcagtactccgtagaacgggcgtattccacgtctccagacactaatcacggcacacgctagtactctgactaaatcgaaacncgacctagagagtcaggacgacgacggtctgtagttacttacgtgtagaacgtaaagtatttaacgaagtaggtaggtaggtacggttacgggggtacgtttcg

SEQ ID NO: 410267 - DNA, 560 bp, Homo sapiens
  misc_feature: GZ8MTXP02GKQE0.11.71.G05.1.454.CMB.2.raw
  modified_base (308)..(308): a, c, t, g, unknown or other
  modified_base (384)..(384): a, c, t, g, unknown or other
  modified_base (415)..(415): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccagcctgggagtccctgagactctcctgtacagcctctggcttcaccttcattacctatgcatgcacgtcgggcccnccagacctccgaggcgagggggctgggagtggggtgctagtttattcaatagtgaagttaggaaattgtgtacttntattcagactcgtagaacggcatcaccgtcncagacacatccagcacacgctagtatctagacaaatacgaaactacgaccgtaggaacgaacgcgtagggaacggaaccgacggtcgttacggttagttaacttaacgtggtacgacggtaaaagtactttacgtaagttaaggg

SEQ ID NO: 410268 - DNA, 616 bp, Homo sapiens
  misc_feature: GZ8MTXP02FVSD0.11.71.G05.1.454.CMB.2.raw
  modified_base (248)..(248): a, c, t, g, unknown or other
  modified_base (263)..(263): a, c, t, g, unknown or other
  modified_base (268)..(268): a, c, t, g, unknown or other
  modified_base (312)..(312): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggaggagtcgtgggggaggcgtggtccagccgtgggagtcccngagctctcctgtacngcctntggtcttcaccttcattacctatggcatgccacgtcgggtcccnccagcctccgaggcgagggggctgggaggtggggtgctagttattcattagtgagtagggaatgtagtactttactattacagtacctccggtaggaaacgggcccgtattccgacccgttcacccgaggacgaactaacgttcccgaggaccacgaacgtctacgttatcgtacgaacaaagtacgaaacgacgtaccgtagaacggagtacgtagggaacggtaaccgacgggtacgttacggtagttaacgttaacgtgtacggtaaacggtaaagtttactttaacgtaagttaaagggg

SEQ ID NO: 410269 - DNA, 592 bp, Homo sapiens
  misc_feature: GZ8MTXP02GA757.11.71.G05.1.454.CMB.2.raw
  modified_base (248)..(248): a, c, t, g, unknown or other
  modified_base (294)..(294): a, c, t, g, unknown or other
  modified_base (327)..(327): a, c, t, g, unknown or other
  modified_base (407)..(407): a, c, t, g, unknown or other
  modified_base (477)..(477): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccagccgtgggacgtccctgagactctcctgtacngcctctgcttcaccttcattacctatggcatgcacgtcgggtcccnccagcctccgaggccgaggggctgggagtgggngctagtttattcatatgataggaaattagtagtacttctaattcgagtaccgtcgtagaacgggcctaattccaccgtcncagagactatcacgacacacgctgtactctagaactaaatacgaaactacgacccgtagacggacgacgnggaaacggacgaaccggtcgttagttagttagttaccgtaggtacgtaacgtaaagttaacgtttaacgtaagtaacggtagggtacggtaacgggtacggggtacgttttacgg

SEQ ID NO: 410270 - DNA, 588 bp, Homo sapiens
  misc_feature: GZ8MTXP02IZGEH.11.71.G05.1.454.CMB.2.raw
  modified_base (265)..(265): a, c, t, g, unknown or other
  modified_base (270)..(270): a, c, t, g, unknown or other
  modified_base (308)..(308): a, c, t, g, unknown or other
  modified_base (379)..(379): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcggtggtccagccgtgggagtccctgagactctcctgtacngcctntgcttcaccttcattacctatggcatgcacgtcggccncagacctccgaggcgaggggctagggagtggggtgctagtttattcatatgataggaatcgtagtaccttntattcgagtactccgtagaacggaccgtatcgaccgtctaccgaagtaacgaactaaacttccgaaggaccaacacgtctacgttaacgtactacgaactaaagtacgaaacgacgtaccgtagagtaacgcgtaggacggaccgaacggtcgttagtacgttagttaacgtagtacggtaacgtaaagttactttacgtaagttaagg

SEQ ID NO: 410271 - DNA, 543 bp, Homo sapiens
  misc_feature: GZ8MTXP02GBYYC.11.71.G05.1.454.CMB.2.raw
  modified_base (271)..(271): a, c, t, g, unknown or other
  modified_base (353)..(353): a, c, t, g, unknown or other
  modified_base (367)..(367): a, c, t, g, unknown or other
  modified_base (431)..(431): a, c, t, g, unknown or other
  modified_base (463)..(463): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggagtccctgacgactctcctgtacagcctcnggcttcaccttcattaccctagtggctatgcacgtgggtcccacagacctcaggcgagggggctgggagtgggtgcagtttntcatatgatgatgngtacttctattcgagctcgagacggctactcaccgtctccgagacactactcgacgcacgtacncgttagtactactagactaaaactcgtaaacncgaccgtagaagacgactaggacggacgacggcttagtgttataacgtcggtagacgtaacgtatttacgtagttaaggg

SEQ ID NO: 410272 - DNA, 647 bp, Homo sapiens
  misc_feature: GZ8MTXP02G59GZ.11.71.G05.1.454.CMB.2.raw
  modified_base (257)..(257): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtgggaggagtcgtgggggagcgtggtccagcctgggagtccctgagctctccngtacagcctctggcttcaccttcattacctatggcatgcacgtcgggtcccgccagacctccgaggccgagggggctggggaggtggggtggctagtttattcatatgataggaatgtgtacttctattcgagtactccgtaggaaacgggcctacgttccgacccgttactacccgaaggtaacgtaacctaacgtttcccgaacgggacctaaaccgaccggtaccttagttaacgttaccacggtaaccaaaagttacggaaaccgaacggtcccgtaggaagtacgacgtacgggaacggaaacgcccgggtacgttcggtaaggtttaacttaacggttacggtagaaaccggttaaaagttactttaacgttaagttaaagggg

SEQ ID NO: 410273 - DNA, 672 bp, Homo sapiens
  misc_feature: GZ8MTXP02FMZ7B.11.71.G05.1.454.CMB.2.raw
  modified_base (316)..(316): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtgggaggagtcggtgggggaggcgtggtccagccgtgggacgtccctgacgactctcctgtacagcctctggcttcaccttcattacctatggcatgcacgtcgggtccnccagctccgaggcgaggggctgggagtggggtgctagttattcatatgagttagaatgtgtacttctattcgagtaccgtccgtaggaacgggtccgtaacttccgtacccgttcctacccgaaggtaacgaactaaacgttacccgaagggaccaaaccgtaccgtaccttaggttaccttacgttacgaacctaaaagtacgaaaacgtacggacccgtaggaacgacggtacgtacggggaaacgggtaaccgtaaccgggtccgttacgggttaggtttaaacgttaaccggtacgggttaaggaaaccggttaaaacgttagttttaaccggttaaggtttaaaacggggg

SEQ ID NO: 410274 - DNA, 665 bp, Homo sapiens
  misc_feature: GZ8MTXP02I2PV7.11.71.G05.1.454.CMB.2.raw
  modified_base (244)..(244): a, c, t, g, unknown or other
  modified_base (293)..(293): a, c, t, g, unknown or other
  modified_base (363)..(363): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacngcctctggcttcaccttcattaccctatggcatgcacgtcggggtcccnccagacctccgaggcgagggggctgggagtggggtgctagttattcatatgagtagaaatgtagtacttntaattcaagtacctccggtaggaacgggtcccgtattcccacccgttcctacccgaagacgaaactaaacgttacccgacggacaaccgaccgtactacgttactcgtacggtactaaaagttacgaaacgacgtacccgtagaacggtacggtacgtacggaacggaaaccgaacgggtccgttaggttaggttaacgttaaccggtacggggtaaccgtaaaaaggtacttttaacgtaaaggttaacggtagggttacgggtaaccggttaccgggggttactttacggtttaaccggg

SEQ ID NO: 410275 - DNA, 599 bp, Homo sapiens
  misc_feature: GZ8MTXP02HRIUR.11.71.G05.1.454.CMB.2.raw
  modified_base (292)..(292): a, c, t, g, unknown or other
  modified_base (337)..(337): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagttttgggctgagcgtggttttcgtcgttagctctttaagaggtgtccagtgtcaggtgcaactggaggagtcgtgggggagcgtggtccagcctgggaggtccctgagactctcctgtacagccctgtggtcttcaccttcattacctatgctatgcacgtcggccncagactccgaggcgaggggtctggaggtgggtgcgtagtttattntatatagtagtagtaagtagtagttacttacttacttctacgtacgtacgtacggacggtacgtactacctaccgtcgtaccgacgacgaactaacgtaccgtacgaccgacgacgtacgtacgtacgtactacgtaactaagtagtacgacgacgtacgagacgacgacggacgacgacgtcgtgttacgttacgttacgtacgtacgtacgtaagttagttaagtagtacggtacggtacggtacggtacggtacggtcg

SEQ ID NO: 410276 - DNA, 537 bp, Homo sapiens
  misc_feature: GZ8MTXP02H9Q4P.11.71.G05.1.454.CMB.2.raw
  modified_base (289)..(289): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggagagtcgtgggggaggcgtggtccagcctgggaggtccctgagactctcctgtacagcctctggcttcaccttcattaccatggcatgcacgtgggtccnccagacctccgaggcagggggctgggagtggggtggctagttattcatatgatggaaatgtgtacttctatttcagtactccgtagaaggggccgattccacccgtctcccagacgacaattccaggcacacgctgtatctgacaaatgaacagcctagacgagctaggaggacgacggtctagttgtattactgtagacgtaagtatttaacgtagtaggaggtagtacggtaacggggtcgttacg

SEQ ID NO: 410277 - DNA, 617 bp, Homo sapiens
  misc_feature: GZ8MTXP02I9JH6.11.71.G05.1.454.CMB.2.raw
  modified_base (316)..(316): a, c, t, g, unknown or other
  modified_base (350)..(350): a, c, t, g, unknown or other
  modified_base (501)..(501): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaaggaggtgtccagtgtcaggtgcaacgtggaggagtcgtgggggaggcgtggtccaggccgtgggacgtccctgagactctcctgtacagcctctggcttcaccttcattacctatcggcatgcacgtgggtcccncagacctccgaggccgaggggctgggagtggggngctaggtttattcattatgaagtagaacttgtcgtaactttcattcaagtaccgtcgtagaacgggcctagttccgacccgtctacccgagaacgactactccgaggccaacacggtcttagtactacctagtaacaaacgttcgaaaacncgtaccgtagaacggtacgcgtaggaacggtaacgacggtcgttacggttagtaacgttaaaccgtggttaacgaaccggtaaaagttacgtttttaaccgaagtttaaaacgggg

SEQ ID NO: 410278 - DNA, 588 bp, Homo sapiens
  misc_feature: GZ8MTXP02IKCYN.11.71.G05.1.454.CMB.2.raw
  modified_base (373)..(373): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggaggtccctgagactctcctgtacagcctctggtcttcaccttcacttacctatggcatcgacacgtcgggtcccgaccaggacctccgagggccgagggggctgggaggtggggtgctagtttattcatatgtataggaaatgtgtactttntattcgaagacctccggtaggaacggggtcctatttcccaccgttctacccagaagacaattccgagaccacgacgtctagtactcgtagactaaatacgaacacgccgtagagacgtcgtaaggacggacgacggtcgtagttagtattacgtagtagtaacgtaagttattaagtagtaacggtaggtaggtacggtacggggtactttacgg

SEQ ID NO: 410279 - DNA, 610 bp, Homo sapiens
  misc_feature: GZ8MTXP02I4FCI.11.71.G05.1.454.CMB.2.raw
  modified_base (246)..(246): a, c, t, g, unknown or other
  modified_base (324)..(324): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcggtggtccagcctgggaggtccctgagctctcctgtacngcctctggcttcaccttcattacctatggcatgcacgtgggtccgccagacctccgaggcgaggggctggaggtgggngctagtttattcatatgagtagaaattagtgtactttctattcacgtacctcggtagaacggggctattccgaccgtctaccagacgactaacttcgacgcacacgctagtactctagactaaatacgaacacgaccgtaggacgacgtacgtaggaacggtaccgacggtcgtggttacggttactttacggtagggtacgtaaacggtaaacgtttaagtttaacgttaaagttagggaacgggttacggttaaccgggttaacgggggttcgtttttaaccgg

SEQ ID NO: 410280 - DNA, 574 bp, Homo sapiens
  misc_feature: GZ8MTXP02G2XGE.11.71.G05.1.454.CMB.2.raw
  modified_base (247)..(247): a, c, t, g, unknown or other
  modified_base (291)..(291): a, c, t, g, unknown or other
  modified_base (296)..(296): a, c, t, g, unknown or other
  modified_base (309)..(309): a, c, t, g, unknown or other
  modified_base (313)..(313): a, c, t, g, unknown or other
  modified_base (331)..(331): a, c, t, g, unknown or other
  modified_base (354)..(354): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggttttcctcgttgctcttttaagaggtgtccagtgtcaggtgcaactgggaggagtcgtgggggaggcgtggtccagcctgggaggtccctgagactctcctgtacngcctctggcttcaccttcattaccatggcatgcactgggtcccncagcncgaggcgaggggntggnggtgggtgctagttattnatagtgagtagaatgtgtacttntatcacgtacgtcggtaggacgggctacttccgtaccgtctacgagacgaactaacgtccgacgacacgacgtcgtagtactcgtagaactaaatacgaacgacgaccgtagagacgtcgaggaacggacgacggtcgtagtagttacgttacgtaggtacgtaacgtaagttacgttaagtagtacggtacggtacggtacggtacggggtacgttacg

SEQ ID NO: 410281 - DNA, 537 bp, Homo sapiens
  misc_feature: GZ8MTXP02GHHNK.11.71.G05.1.454.CMB.2.raw
  modified_base (305)..(305): a, c, t, g, unknown or other
  modified_base (348)..(348): a, c, t, g, unknown or other
  modified_base (366)..(366): a, c, t, g, unknown or other
  modified_base (372)..(372): a, c, t, g, unknown or other
  modified_base (408)..(408): a, c, t, g, unknown or other
  modified_base (446)..(446): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagctctcctgtacagcctctggcttcaccttcattacctatggcatgcacgtgggtccnccagactccgaggcgagggggctgggagtggggtggctagttntttcatatgatgaatgtntacttntattcagtactcgtaggaaggccgattcaccgttcnccagacgactacttccgaggtcaccgacgtctgtactntacgacaaatgaaacctagcctagacgacgctaggacggacgacggtctagtcgtataacgtgtagtacgaacgtatttacgtagttaagg

SEQ ID NO: 410282 - DNA, 553 bp, Homo sapiens
  misc_feature: GZ8MTXP02GQXQY.11.71.G05.1.454.CMB.2.raw
  modified_base (244)..(244): a, c, t, g, unknown or other
  modified_base (258)..(258): a, c, t, g, unknown or other
  modified_base (265)..(266): a, c, t, g, unknown or other
  modified_base (282)..(282): a, c, t, g, unknown or other
  modified_base (289)..(289): a, c, t, g, unknown or other
  modified_base (424)..(424): a, c, t, g, unknown or other
  modified_base (430)..(430): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggaggtcctgagactctcctgacngctcgtgctcactnacttacnngcatgcacgtcggccncagaccncgaggcggaggggctgggaggtgggtcgactagtttattcagtagtaggaagtaggaaaatgtacgtacttactatcgacgtacgtcggtagaacggctatccaccgtcacagacactactacgacgacacacgntgtacnctagaacaaagtagaacacgacgagagagacgagacgacgacgtacgtagtagtacgtacgtacgtacgtaacgtaagtagttaagtaagtaggtacggtacggtacggtacgggtacgtacg

SEQ ID NO: 410283 - DNA, 684 bp, Homo sapiens
  misc_feature: GZ8MTXP02FXZ5Z.11.71.G05.1.454.CMB.2.raw
  modified_base (249)..(249): a, c, t, g, unknown or other
  modified_base (275)..(275): a, c, t, g, unknown or other
  modified_base (294)..(294): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggacggtccctgagactctcctgtaacncgcctctgtctcaccttcacttactntgcatcgcacgtcggtccncagacctcgaggcggaggggctggggaggtgggtcgacgtagtttacttcgattagtggtaacgtaggtaaaattaggtacgttactttacgttaagttccgaacgtaccgttcggtagggaaccgggtccgtaacttcccgtaccgtccgtaccgaacgtaacgtaactaacgtaccgacggaccaacgtacgtacttagtactcgtagaactaaagtacgaaacgacgtaccgtaggacggacgtacgtacgggaacggaccgacggtacgttaggttaacgttaacgtttacggtacggttacggtaaacggttaaacgttaactttaacgttaaaggtaacgggtaacgggtacggtaaccggggttaccgggggttcgtttacgg

SEQ ID NO: 410284 - DNA, 604 bp, Homo sapiens
  misc_feature: GZ8MTXP02IL8HE.11.71.G05.1.454.CMB.2.raw
  modified_base (246)..(246): a, c, t, g, unknown or other
  modified_base (251)..(251): a, c, t, g, unknown or other
  modified_base (290)..(290): a, c, t, g, unknown or other
  modified_base (400)..(400): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggacggtccctgagactctctgtacngcctntgcttcaccttcattaccatggcatgcacgtcgggtccnccagacctcgaggcgagggggctgggaggtgggtgctagtttattcatatgataggaaatgtgtacttctattcagtactccggtagaacggggtccattccgaccgtcnccagacgactaacttccgacggccacgacgtctagtactctagaactaaagtacgaaacgacgtaccgtagacggagtacgtacggaaacggacgaaccgggtcttaggttacgttaagtttacgtaggttacggtaaacgtaaagttacgtttaacgtaagtaaggtacgggtacggtacgggttaccgggggtactttacgg

SEQ ID NO: 410285 - DNA, 579 bp, Homo sapiens
  misc_feature: GZ8MTXP02IW57I.11.71.G05.1.454.CMB.2.raw
  modified_base (248)..(248): a, c, t, g, unknown or other
  modified_base (253)..(253): a, c, t, g, unknown or other
  modified_base (292)..(292): a, c, t, g, unknown or other
  modified_base (324)..(324): a, c, t, g, unknown or other
  modified_base (427)..(427): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagcctgggaggtccctgagactctcctgtacngcctntggcttcaccttcattaccatggcatgcacgtgggtccnccagacctcgaggcgaggggctgggagtgggngctagtttattcatatgataggaaatgtgactttctattcgagtactccggtagaacgggtcctattccaccgtctaccagacgacaacttcgacgcacgacnctagtatcgtagaactaaatacgaacacgtaccgtagacgacgacgtaggaacggacgacggtacgttgtagttacgttacgtggtacgaacgtaaagttactttaacgttaagtacggtaggtacggtacggtacgggggtacgtttacgg

SEQ ID NO: 410286 - DNA, 685 bp, Homo sapiens
  misc_feature: GZ8MTXP02GZ4GF.11.71.G05.1.454.CMB.2.raw
  modified_base (266)..(266): a, c, t, g, unknown or other
  modified_base (271)..(271): a, c, t, g, unknown or other
  modified_base (313)..(313): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggttgtccagtgtcaggtgcaacgtggaggagtcgtgggggagcgtggtccagccgtgggacgtccctgagctctcctgtacngcctntggcttcaccttcattacctatggcatgcacgtcgggtcccnccagacctccgagggccggaggggggtctggggaggtggggtcgtcgtagtttatttcgattagtggaagttagggaaattcgtagtacctttactatttaccagtacccgttccggtaggaacgggtccgtaacgttacccgaacccgtctacccgaagacgtaaacctaacgttcccgaaaggccaacgaccgtacgtagttactacgtacgaacctaaagtacgaaaccgtacggacccgtagaaggtacgaccgtaagggaaccgggaaccggtaaaccgggtccgttacgggttacgtttaaacgttaacgtacggttaaggaaaccggttaaaaggttaccttttaacgtaaggtttaaacggggg

SEQ ID NO: 410287 - DNA, 547 bp, Homo sapiens
  misc_feature: GZ8MTXP02I1RKV.11.71.G05.1.454.CMB.2.raw
  modified_base (267)..(267): a, c, t, g, unknown or other
  modified_base (363)..(363): a, c, t, g, unknown or other
  modified_base (395)..(395): a, c, t, g, unknown or other
  modified_base (470)..(470): a, c, t, g, unknown or other
  modified_base (515)..(515): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggacggtccctgacgactctcctgtacngcctctggcttcaccttcattacctatggcatgcacgtcggtcccgccagacctcgaggccgagggggctgggagtggggtgctagtttattcatntgattaggatgtgtacttctattcagtctcgngacggctactcgacctctccagacgacacttcgacggtacacgacgtctagtactctacgacaaagtcgaaaacngacgtagagcgcgtaggacgacgacgtcgtagtagttattaacgngttacgacggtaaagttacttactagtaaggg

SEQ ID NO: 410288 - DNA, 679 bp, Homo sapiens
  misc_feature: GZ8MTXP02GGQJ2.11.71.G05.1.454.CMB.2.raw
  modified_base (310)..(310): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggagcgtggtccagccgtggggacgtccctgagctctcctgtacagcctctggcttcaccttcattacctatggcatgcacgtcgggtccnccagacctccgaggcgagggggctgggagtggggtgctagtttattcattatgataggaatgtgtacttctattcagtaccttccgttaggaaacgggtcccgtaattcccgtaacccgttcctaccccgaagtaacgtaacctaaacgtttcccgaaacgggacccaaccgtaaccggtcttaacggttaacttccgttaacgaccctaaaaagttacggaaaaccgacggtacccgtaaggaacggaacggtacccgttaggggaaaccgggaaccgtaacgggtccgttacggttaaggttaacgtttaaccgttacggtaggtaaaccggtaaaaggttacttttacggtaaagtttaacggggg

SEQ ID NO: 410289 - DNA, 715 bp, Homo sapiens
  misc_feature: GZ8MTXP02G2VTF.11.71.G05.1.454.CMB.2.raw
  modified_base (276)..(276): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagtcttgggttttcctcgttgcttcttttaagaggtgtccagtgtcaggtgcaacgtggaggagtcggtgggggagtcggtggtccaggccgtggggacggtccctgacgtctcctccgtgtacngtcctcgtcgccttaccacctttcaacttacctagtggacatcgacctacgttcggggtcccaccacgtacctccggaaggggcggacggggggtctaggggacgggtggggtacggtacttaggtttactttcaagttagtggtaaagttaggggaaattcggttgtaacctttactaacgttcgaaacggttcccgttaccggtaggtaaaccggggtaccgttaacttaccgtaacccgttccgtaccgaacggtaaacgtaacctaaccgttaccgaaggaccctaacgacgtcgttagtacgtactacgaacgtaaactacgaaactaccgtacgtagaacgtacgaccggtaggaacggacgacggtacgttaggtacgtttaacgttaagtacggtacgtaacgtaaaagtttactttacgtaaggtaaggg

SEQ ID NO: 410290 - DNA, 582 bp, Homo sapiens
  misc_feature: GZ8MTXP02IEUXG.11.71.G05.1.454.CMB.2.raw
  modified_base (183)..(183): a, c, t, g, unknown or other
  modified_base (246)..(246): a, c, t, g, unknown or other
  modified_base (251)..(251): a, c, t, g, unknown or other
  modified_base (264)..(264): a, c, t, g, unknown or other
  modified_base (290)..(290): a, c, t, g, unknown or other
  modified_base (323)..(323): a, c, t, g, unknown or other
  modified_base (331)..(331): a, c, t, g, unknown or other
  modified_base (337)..(337): a, c, t, g, unknown or other
  modified_base (389)..(389): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtncaactggagagtcgtgggggaggcgtggtccagccgtgggaggtccctgagactctctgtacngcctntggcttcaccttnattaccatggcatgcacgtgggtccnccagactccgaggcgagggggctaggagtgggngctagttnttcatngataggaaatgtgacttctattcagtactcgtagacgggccattccaccgtntccagacgacatcgagcacacgctagtatctgactaaagtcgaacacgtccgaagacgtacggaccgttaggaacgggtaccgaaccgggtcttacggttaggttaacttacggtaggttacgaacggttaaagttacgtttaacgtaaacgtaggtacgggttaggtaaccggttacgggggtactttccgg

SEQ ID NO: 410291 - DNA, 806 bp, Homo sapiens
  misc_feature: GZ8MTXP02HD4OB.11.71.G05.1.454.CMB.2.raw
  modified_base (269)..(269): a, c, t, g, unknown or other
  modified_base (755)..(755): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttacttttaagaggtgtccagtgtcaggtgcaacgtggaggagtcgtgggggagcgtggtccagccgtggggacgtccctgacgactcctctgtacncgcctgtcgtccttcctaccttctaacttacctagtcggactagttcggaccctaccggttcggggtaccccacccgtaacggtaccccgtccccgggaaggggtcccggggtaacgggggggggtccgttaggggggtaagggggtttcgggggggtacgggtaacctttaaggggttttttaacctttaccgtaaagtttaacggttagggtaaaggtttaaaggggtaaacgtttgggttaacggttaacctttttacgttaactttacggaaacgttacccggttaccgggtaacgggaaccgggggtacccttacgtttacccgacccgtttaccgtacccgaaacggtaacgtaaaccgtaacgttacccggaacggtaccaaaccgtaccggttacttacggttacttaccgtaacgaaacctaaagtaacggaaacctacggtaccgtagacgacgacgtaggaacggtacgacggtntacggtattacgtaacgtggtacgtacgtaagttattacgtaaggtacggg

SEQ ID NO: 410292 - DNA, 558 bp, Homo sapiens
  misc_feature: GZ8MTXP02GN0MI.11.71.G05.1.454.CMB.2.raw
  modified_base (292)..(292): a, c, t, g, unknown or other
  modified_base (357)..(357): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggaggtccctgagactctcctgtacagcctctggcttcaccttcattacctatggcatgcacgtgggtccnccagcctccgaggcgagggggctgggaggtggggtgctagtttattcatatgataggaaatagtntacttctattcagactccggtagaacgggcctattccaccgtctaccagacgactaactccaggcacacgctgtatctgacaaatgaacacgcctagagagcgtaggacggacgacggtcgtagttagtacttacgtagtacgtacgtaaagttactttaagtagtacggaggtaggtacggtacgggggtacgtttacgg

SEQ ID NO: 410293 - DNA, 506 bp, Homo sapiens
  misc_feature: GZ8MTXP02FGIL7.11.71.G05.1.454.CMB.2.raw
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattaccctatggcatgcactgggtccgccagactccaggcagggggctgggagtgggtggcaggttatttcatatgatggaaatgtgtacttctattcagactcgtgagggcatcaccgtctccagagacaattccaggcacacgctgtatctgacaaatgaacagcctgagagctagagacacggctgtgtacttacgtgtcgacgaagtattcgtatagaggtgacgtacgggggcttacg

SEQ ID NO: 410294 - DNA, 620 bp, Homo sapiens
  misc_feature: GZ8MTXP02I9YAG.11.71.G05.1.454.CMB.2.raw
  modified_base (314)..(314): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagttgggttttcctcgttgctcttttaagaggtgtccagtgtcaggtgcaactggaggagtcgtgggggagcgtggtccagcctgggacgtccctgacgactctcctgtacagcctctggccttcaccttcattacctatcggcatgccacgtcggggtcccncagacctccgagggcgaggggctgggaggtggggtggctagtttacttcatagtgatagggaaaattggtcgtactttctattcgaacgtacgtccggtaggaacgggtcccgtacgttaccgacccgtcctaccgaacgtaacgaactaacgttccgaggaccacaccgtcttagtactcgtacgaactaaagtacgaacacgtacctaggacgacgtacgtaggaacggacgtaacggtcttaggttacgttacttacgtcgtacgtaacgtaaaagttacgtttacgtaagtacggtaacggg

SEQ ID NO: 410295 - DNA, 637 bp, Homo sapiens
  misc_feature: GZ8MTXP02HJRVZ.11.71.G05.1.454.CMB.2.raw
  modified_base (265)..(265): a, c, t, g, unknown or other
  modified_base (270)..(270): a, c, t, g, unknown or other
  modified_base (311)..(311): a, c, t, g, unknown or other
  modified_base (343)..(343): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggagcgtggtccagccgtgggagtccctgacgactctcctgtacngcctntggcttcaccttcattacctatggcatgcacgtgggtcccncagactccgaggcgagggggctgggagtgggngctagttattcatatgatgaatgtgtacttctattcagtaccgtaccgtggaaacgggtccctaattccgaacccggttctacccgaagtaacgtaacctaaacgttcccgaaggaccaaaccgtaccgtaccgttggtaacttaccgttaggaacctaaaagtacggaaaactacgacccgtaggaacgacggaccgttaggaaacgggaccgtacggtaccgttacggttaacgttaagttaaccgtggtacggtaaacggtaaaagtttactttaacgtaaggttaagggg

SEQ ID NO: 410296 - DNA, 630 bp, Homo sapiens
  misc_feature: GZ8MTXP02FTBM1.11.71.G05.1.454.CMB.2.raw
  modified_base (181)..(181): a, c, t, g, unknown or other
  modified_base (306)..(306): a, c, t, g, unknown or other
  modified_base (346)..(346): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcaactggaggagtcgtgggggagcgtggtccagcctgggagtccctgagctctcctgtacagcctctggcttcaccttcattacctatggcatgcacgtgggtcccncagactccgaggcgaggggctgggagtgggtgctagtttnttcatatgataggaatgtgtaacttctattcgaagtacctccgtaggaaacgggtccgtattcccgaacccgttcctacccgtaaggaacgtaacctaaacgttcccgaaacgggaccaaccgaaccggtccttacggtaacttcctaacggaacctaaaagtcgaaaaccgacgtacccgtaggaagtaacggcgtaagggaacggtaaccgacgggtacgttacggtagttaacgttaaccgtggtacgtaacggtaaaagttactttacgtaagttaaggg

SEQ ID NO: 410297 - DNA, 590 bp, Homo sapiens
  misc_feature: GZ8MTXP02HMXDP.11.71.G05.1.454.CMB.2.raw
  modified_base (250)..(250): a, c, t, g, unknown or other
  modified_base (496)..(496): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccaggcctggggacggtccctgagactctcctgtacngtcctctggcttcaccttctattacctatggcatgcacgtgggtaccacagacctcgaggcgaggggctggaggtgggtgctagttattcatagtgataggaaaactgtacgtactttctattcgagtactccgtagggaacggggtccctaagtttccgaccgtctaccgagacgaactaacttaccgacggcaacgacgctgtactcgtagactaaagacgaacgagccgtagacgacgtacgnggaacggacgaacggtcgtagttagtacttacgttgacgaacgtaagttatttaacgtagtaggtacggtacgtacggtacggggtctttacgg

SEQ ID NO: 410298 - DNA, 570 bp, Homo sapiens
  misc_feature: GZ8MTXP02GW9JI.11.71.G05.1.454.CMB.2.raw
  modified_base (266)..(266): a, c, t, g, unknown or other
  modified_base (313)..(313): a, c, t, g, unknown or other
  modified_base (355)..(355): a, c, t, g, unknown or other
  modified_base (361)..(361): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtgggaggagtcgtgggggaggcgtggtccagccgtgggacggtcctgagctctctgtacngcctctggcttcaccttcacttacctatggcatgcacgtcgggtccncagcctccgaggcgagggggctgggagtggggtgctagtttnttcatngataggaatgtagtacttctattcagtacctcgtaggaacggcctattccaccgtctccagacgaactactccgacgtcacacgtctagtactccgagtaccaaagtacgaaacgtacgaccgtaggagacgtcgtaggaacggacgaccggtcgttacgtagttattcgtaggtacgaacggtaaattactttacgtaagttaagggg

SEQ ID NO: 410299 - DNA, 553 bp, Homo sapiens
  misc_feature: GZ8MTXP02JOZJC.11.71.G05.1.454.CMB.2.raw
  modified_base (245)..(245): a, c, t, g, unknown or other
  modified_base (250)..(250): a, c, t, g, unknown or other
  modified_base (291)..(291): a, c, t, g, unknown or other
  modified_base (332)..(332): a, c, t, g, unknown or other
  modified_base (352)..(352): a, c, t, g, unknown or other
tcagcgagagataccacgaccggtgctcgatttagtgtcgtcgcaagagagaggagcccagcactagaagtcggcggtgtttccattcggtaatcagcactgaacacagaggactcaccatggagtttgggctgagctgggttttcctcgttgctcttttaagaggtgtccagtgtcaggtgcaactggaggagtcgtgggggagcgtggtccagcctgggaggtccctgagactctcctgtacngcctntggcttcaccttcattacctatggcatgcacgtgggtcccncagactccgagggcagggggctggagtggggtgctagtttnttcatatgataggaaatgtntacttctattcagctccggtagacgggcctattccaccgtctccagacgacactccgagacacacgctagtactctagacaaatgaaaccagaccgtagagacgcgtaggacggaccgacggcttaggtagttatacgtagtacgacgtaaagtatttactaagtagtacggtacgacggtacgggggtcttcgtttacgg

SEQ ID NO: 410300 - DNA, 584 bp, Homo sapiens
  misc_feature: GZ8MTXP02JTPM6.11.71.G05.1.454.CMB.2.raw
  modified_base (295)..(295): a, c, t, g, unknown or other
  modified_base (346)..(346): a, c, t, g, unknown or other
  modified_base (553)..(553): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggaggtccctgagactctcctgtacagtctctggcttcaccttcattaccctatggcatgcacgtcggggtccnccagacctccgaggccgagggggctgggagtggggtggctagttattcatntgactagaaatgtgacttctattcaacgtctccggtagaacgggcctaatccgacctctaccagagacaagtccaggccacgacgtctcgtatctacgacaaagtcgaacgtagacccgtagaggacgacgtacggacggaacgacggtcgttggtagttacttaccgtaggtacgtacgtaaagttatttaacgtaagttaacggnggtaggtaaccggttcgggggtctttaccgg

SEQ ID NO: 410301 - DNA, 602 bp, Homo sapiens
  misc_feature: GZ8MTXP02FRYE3.11.71.G05.1.454.CMB.2.raw
  modified_base (245)..(245): a, c, t, g, unknown or other
  modified_base (292)..(292): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggaggtccctgagactctcctgtacngcctctggcttcaccttcattacctatggcatgcacgtcgggtcccncagacctccgaggcgagggggctgggaggtggggtggctaggtttattcatagtgataggaaatgtgtacttctattcgagtcctcggtaggaacggggtcctattcccaccgtctacccgagacgaactaattcccgaggtccaacacgtcttagtacttctagaactaaatcgaaactacgaccgtagaggacgtcgaggaacggaccgaacggtcgtaggttagttaacgttacgtacggtacgaaacgtaaagttactttaacgtaagtaacggtaggtacggtacgggtacgggggtctttacgg

SEQ ID NO: 410302 - DNA, 626 bp, Homo sapiens
  misc_feature: GZ8MTXP02G4N9Y.11.71.G05.1.454.CMB.2.raw
  modified_base (258)..(258): a, c, t, g, unknown or other
  modified_base (311)..(311): a, c, t, g, unknown or other
  modified_base (382)..(382): a, c, t, g, unknown or other
tcagcgagagataccacgaccggtgctcgatttagtgtcgtcgcaagagagagggggggagaggagcccagcactagaagtcggcggtgtttccattcggtgatcagcactgaacgcagaggactcaccatggagtttgggctgagcttgggttttcctcgttgcttcttttaagaggtgtccagtgtcaggtgcaactggaggagtcgtgggggagcgtggtccagccgtgggacgtccctgagactctcctgtacngcctctggccttcaccttcacttacctatcggcatcgctacgtcggggtcccnccagcctccgaggcgagggggctgggaggtggggtgctagtttattcatatagataggaaatgtgtacttntattcagtacctcggtagaacgggtcctattcacccgtctacagagactacttccgacggccacgacgtacgtgtacttcgtagtaaccaaaagttacgaaaacgacgtaccgtaggaacggtacgtaccgtaggaacgggaaccgtacgggtccgttacggttagttaccgtttaacgtgtaacggtaacgtaaaacgttatttaacgttaagtaggtaggtacggtaacggtttaccggggg

SEQ ID NO: 410303 - DNA, 572 bp, Homo sapiens
  misc_feature: GZ8MTXP02J1XJ7.11.71.G05.1.454.CMB.2.raw
  modified_base (263)..(263): a, c, t, g, unknown or other
  modified_base (268)..(268): a, c, t, g, unknown or other
  modified_base (311)..(311): a, c, t, g, unknown or other
  modified_base (492)..(492): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagcctgggagtccctgagactctcctgtacngcctntggcttcaccttcattacctatggcatcgcacgtcgggtcccncagacctcgaggcgaggggctgggagtggggtgactagtttattcgatatgattaggaatgtacgtacttctattcaagtacctaccgtaggaacggtcccgtaattcccgaaccgtcctacccaagaacgaactaaacttccgaaggaccaacacgtctagtaactctacgacctaaaancgaaacacgcctagacgagcgtagacggaccacggtctacgtagtaattgtgtagacgtaaaagtctttaacgagtaagg

SEQ ID NO: 410304 - DNA, 600 bp, Homo sapiens
  misc_feature: GZ8MTXP02JMUNA.11.71.G05.1.454.CMB.2.raw
  modified_base (307)..(307): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggagtccctgagactctctgtacagcctctggcttcaccttcattacctatggcatgcacgtcgggtccncagacctccgaggcgagggggctgggagtggggtggctaggtttacttcgatagtgaagttaggaattgtagtactttctattcacgtactccgtagtaaacggccgtacgttccaacccgttcctaccgtagaacgaactaacttccgaacggaccaacgaccggtctagttactaccgtagacctaaagtacgaaacgacgtcctagacgaggaccgtaggaacggaccgacgggtcgtaggttacgttattaacgtgtacgtacggtaagttactttacgtaagtaaggg

SEQ ID NO: 410305 - DNA, 633 bp, Homo sapiens
  misc_feature: GZ8MTXP02I1FPN.11.71.G05.1.454.CMB.2.raw
  modified_base (164)..(164): a, c, t, g, unknown or other
  modified_base (296)..(296): a, c, t, g, unknown or other
  modified_base (365)..(365): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagnggtgtccagtgtcaggtgcaactggaggagtcgtgggggagcgtggtccagcctgggagtccctgagactctcctgtacagcctctggtccttcacccttcattaccctatggcatgccacgtcgggtcccnccagacctccgaggcgagggggctgggaggtggggtgctagtttacttcattagtgaataggaaatgtntactttcgtattcgacgtactccggtaggaacggggtcctaattcccacccgttctacccgagtaacgaactaacttaccgacggacaaccgacgtccttagttaacttcttacggaacctaaaagttacggaaaaccgtacgcccgtaggaagtacggacctaggggaaccggacgtacgggtacgttaggttacgttaacgttacgtggtacgaacgtaaagtattaacgtagtaggtacggtacgtacggtacggggtctttacg

SEQ ID NO: 410306 - DNA, 567 bp, Homo sapiens
  misc_feature: GZ8MTXP02INUDG.11.71.G05.1.454.CMB.2.raw
  modified_base (181)..(181): a, c, t, g, unknown or other
  modified_base (313)..(313): a, c, t, g, unknown or other
  modified_base (380)..(380): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcaactggaggagtcgtgggggaggcgtggtccagccgtggggacgtccctgagctctcctgtacagcctctggcttcaccttcattaccctatggcatgccacgtcgggtcccnccagacctccgaggccgaggggctgggagtggggtgctagttattcatatgatggaatgtgtacttntattcagtactccgtgacggctattccacccgtctccgagtacgaacaacgttccaacggccacgacgactgtactactagaccaaatcgaaacacgaccgtagagaagtcgaggacgggaaccacgggcttacgtagtttaattaacgtgttacggaacgtaaagttactttacgtaagttaaggg

SEQ ID NO: 410307 - DNA, 576 bp, Homo sapiens
  misc_feature: GZ8MTXP02GFJTG.11.71.G05.1.454.CMB.2.raw
  modified_base (246)..(246): a, c, t, g, unknown or other
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggaggtccctgagactctcctgtacngcctctggcttcaccttcattacctatgcatgcacgtgggtcccncagacctccgaggcgagggggctgggaggtgggtggctagtttatttcaattatgaacgtaggaaatagtcgtactttctattccgagtacgtccggtagaacggggcctattccaccgtctaccagaagactaattccacggtcaacgacgtctagtactctagactaaatacgaacagaccgtagacgagtacgagacgacgacggcgtagtgttactacgtgtacgacgtaagttattaagtagtaacggtaggtacgtaacggtacggggtacgtttacgg

SEQ ID NO: 410308 - DNA, 621 bp, Homo sapiens
  misc_feature: GZ8MTXP02HOPC6.11.71.G05.1.454.CMB.2.raw
  modified_base (247)..(247): a, c, t, g, unknown or other
  modified_base (292)..(292): a, c, t, g, unknown or other
  modified_base (327)..(327): a, c, t, g, unknown or other
  modified_base (364)..(364): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggttgagctgggttttcctcgttgctcttttaagaggtgtccagtgtcaggtgcaactggaggagtcgtggggggaggcgtggtccagcctgggaggtccctgagactctcctgtacncgccctggcttcaccttcattacctatggcatgcacgtgggtccnccagcctccgaggcgagggggctgggaggtggggnggctagtttattcatagtgataggaaatgtgtacttntattcagctcgtgaacggcctatccgaccgtcacagagactaacttcaggacaccacgctgtactctagacaaatacgaaacagtaccgtagagacgcgtaggaacggaccgaacgggtccgttaggttacggttaactttacggttagtacggtaaacggtaaaacgttagttttaaccgtaaagttaagggtaacggggttacggtaaaccggggttaccgggggttacgtttaccggttttacggtaacccggg

SEQ ID NO: 410309 - DNA, 577 bp, Homo sapiens
  misc_feature: GZ8MTXP02GDWSU.11.71.G05.1.454.CMB.2.raw
  modified_base (244)..(244): a, c, t, g, unknown or other
  modified_base (291)..(291): a, c, t, g, unknown or other
  modified_base (432)..(432): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggaggtccctgagactctctgtacngcctctggcttcaccttcattacctatggcatgcacgtcgggtcccnccagacctccgagggcgagggggctgggaggtgggtgctagtttattcatagtgataggaaatgtagtacttcttattcgagactccggtgaacgggcctaaagttccaccgtctacccgagaagactaatccgagcaacncgactgtatctagacaaagtacgaaacacgcctaggagacgacgtagaacggacgacggtctggtagttacttaacgtgtacgaacgtaaagttacttaagtaagtacggtaggtacggtacggttacgggggtcgttttaacgg

SEQ ID NO: 410310 - DNA, 575 bp, Homo sapiens
  misc_feature: GZ8MTXP02GOV9Y.11.71.G05.1.454.CMB.2.raw
  modified_base (294)..(294): a, c, t, g, unknown or other
  modified_base (326)..(326): a, c, t, g, unknown or other
  modified_base (450)..(450): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggaggtccctgagactctcctgtacagcctctggccttcaccttcattaccctatggcatgcactgggtcccnccagacctccgaggcgaggggctggagtgggnggctagttattcatatgatggaaatagtgacttctattcagactcgtagaagggccgattcaccgtctccagagacaatccgagcacacgctgtactctagacaaagtagaaacacggtacccnggaaggacgtacgtacggaagggaaccgtaacggtccgttaggttgttaacgttacgtgtacggtaacgtaaagttagtttcgtaaggtaaggtaggtaggtaacggtacgggggtactttccgg

SEQ ID NO: 410311 - DNA, 640 bp, Homo sapiens
  misc_feature: GZ8MTXP02F0SH1.11.71.G05.1.454.CMB.2.raw
  modified_base (374)..(374): a, c, t, g, unknown or other
  modified_base (425)..(425): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggacgtcctgagactctctgtacacgcctcgtggtcttcaccttcacttacctagtcggctagtcgcctacgtcgggtccccgccagaccctccgaggcggaggggctggaggtgggtgctagtttattcatatgatagtaaatgtagtacttntaattcgacgtactccggtagaacggggcctagttccaccgtctaccaganaactaactacgacggacaacacgtactagttaacgtctagaactaaagtacgaaaaccacgtacccgaaggacggacgtacgtaggaacggaccgtacggtcgtttagggtactttaacgttacgtaggtaccggtaacgtaaaagtttagttaaccgtaaggttaacggtaaggggtaccggtaacggggttaccgggggttacgttttaccgg

SEQ ID NO: 410312 - DNA, 548 bp, Homo sapiens
  misc_feature: GZ8MTXP02IGZEX.11.71.G05.1.454.CMB.2.raw
  modified_base (244)..(244): a, c, t, g, unknown or other
  modified_base (262)..(262): a, c, t, g, unknown or other
  modified_base (289)..(289): a, c, t, g, unknown or other
  modified_base (351)..(351): a, c, t, g, unknown or other
  modified_base (377)..(377): a, c, t, g, unknown or other
  modified_base (400)..(400): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacngcctctggcttcaccttnattacctatggcatgcactgggtcccnccagacctccgaggcgagggggctgggaggtgggtgctagttattcatatgataggaaatgngtacttctattcgagtactccggtanaacggggcctatttccaccgtcnccaagacgacaacttcaggcacacgctgtatctgacaatgaactgacctgagagtcaggacgacacggtctagtacgttattacgtgtacgaacgtaatactttaagtaagttacggtacggtagaccggttacgggggtactttacg

SEQ ID NO: 410313 - DNA, 571 bp, Homo sapiens
  misc_feature: GZ8MTXP02GOHT3.11.71.G05.1.454.CMB.2.raw
  modified_base (262)..(262): a, c, t, g, unknown or other
  modified_base (267)..(267): a, c, t, g, unknown or other
  modified_base (306)..(306): a, c, t, g, unknown or other
  modified_base (329)..(329): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggagtccctgagactctcctgtacngcctntggcttcaccttcattacctatggcatgcagtcggtccncagctcgaggcgaggggctgggngtggggtgctagtttatttcgagtactgaacgttaggaaattgtgtaactttctattaccagtaccctccgtaggaaacggccgtattccacccgtctacccgagacgtaacaacgttccacggcaccgacgcttagtactcagacaaatagaacacgaccgtagagacgcgtaggaacggtacgacggtcttagtacgttaattaacgtggtacgaacgtaagtactttacgagttaaggg

SEQ ID NO: 410314 - DNA, 659 bp, Homo sapiens
  misc_feature: GZ8MTXP02GDLVZ.11.71.G05.1.454.CMB.2.raw
  modified_base (291)..(291): a, c, t, g, unknown or other
  modified_base (320)..(320): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctggggagtccctgagactctcctgtacagcctctggcttcaccttcattacctatggcatgcacgtgggtccncagacctcgaggcaggggctggagtgggngctagttattcatagtgatagaatgtgtacttctattcagtacttccggtagtaacggggtcactttcccaacccggttccttacccgaaggaacgtaacctaaacgtttaccccgaacgggaccaaaccgtacccgtacgttaggttaaacttccgttagaacctaaagtacggaaactacgcccgtagacgacggtacgacgtaacgggacgaaccggtcgtacggttacgtttagtttaaccggtagttacgtaacggtaaaagttaacgtttaacgttaaaggttaaggtacggggtacggtaaaccgggttccgggggttacggttttaaccgg

SEQ ID NO: 410315 - DNA, 594 bp, Homo sapiens
  misc_feature: GZ8MTXP02IOHVZ.11.71.G05.1.454.CMB.2.raw
  modified_base (261)..(261): a, c, t, g, unknown or other
  modified_base (302)..(302): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcaacgtggaggagtcgtgggggagcgtggtccagcctgggagtccctgagactctcctgtacagcctntggcttcaccttcattacctatggcatgcacgtgggtcccnccagacctccgaggcgagggggctgggaggtggggtgctagtttattcattatgatgaaatgtagtacttctattcagtcctcgtgaacgggccattccaccgtctaccagacgaactacttccgaggtccacgacgtctgttactcgtagaactaaatacgaacacggacctaggagacgcgaggaacggaccgaaccggtcttacggttacgtaagtttaccgtaggtacgaacggtaaaagttattttaccgtaagtaaggtacggttacggtaacggtttaccggggg

SEQ ID NO: 410316 - DNA, 540 bp, Homo sapiens
  misc_feature: GZ8MTXP02FFPFL.11.71.G05.1.454.CMB.2.raw
  modified_base (265)..(265): a, c, t, g, unknown or other
  modified_base (303)..(303): a, c, t, g, unknown or other
  modified_base (355)..(355): a, c, t, g, unknown or other
  modified_base (370)..(370): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggaggagtcgtggggggaggcgtggtccagcctggggaggtccctgagactctcctgtacagcctntggcttcaccttcattacctatggcatgcacgtggccncagactccgaggcgagggggctgggagtggggtgctagttatttcatatganaggaaatgtgacttntattcagacctcgtagaacgggccgtattcaccgtctacagagacattcgacgcacgacgctgtatctagacaaatagaaacagaccgtagagagcgtgacggacgacggctagtagttacttacgtgtagacgaaagtatttactagtagtaggtcgacggtacggggg

SEQ ID NO: 410317 - DNA, 575 bp, Homo sapiens
  misc_feature: GZ8MTXP02JMK71.11.71.G05.1.454.CMB.2.raw
  modified_base (245)..(245): a, c, t, g, unknown or other
  modified_base (250)..(250): a, c, t, g, unknown or other
  modified_base (289)..(289): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagcctgggagtccctgagctctcctgtacngcctntgcttcaccttcattacctagtgcatgcacgtgggtccnccagacctcgaggcgaggggctgggaggtgggtgctagtttatcgatagtagagtacggtaaatgtagtacttctattcagtcgtccggtagaacgggtcctatccaccgtctaccgagacgactacgtccaggccaacgacgtactacgtatccgtagaccgtaaatagaacgacgtccgtagaagtgacgaggacggacgacggtcttaggtagttacgtacgtagtacgtaacgtaagttattaacgtagtacggtacggtacgtacgggtacgggtacttcg

SEQ ID NO: 410318 - DNA, 566 bp, Homo sapiens
  misc_feature: GZ8MTXP02G3DKW.11.71.G05.1.454.CMB.2.raw
  modified_base (268)..(268): a, c, t, g, unknown or other
  modified_base (273)..(273): a, c, t, g, unknown or other
  modified_base (314)..(314): a, c, t, g, unknown or other
  modified_base (481)..(481): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccaggccgtggggacgtccctgagactctcctgtacngcctntggcttcaccttcattacctatggcatgcacgtgggtcccnccagctccgaggccgaggggctgggagtggggtgtcagtttattcatatgagtaggaacttgtgtactttctattacgagtcctccgtagaacgggcctagttccaccgtctaccagacgaactactccaggccaacacgtctagtactcgtagacaaaatgaaacngaccgtagacagcgtaggacggaaccgacggtcgttagtacgttagttcgtggtaggaacgtaaagtactttacgaagttaaggg

SEQ ID NO: 410319 - DNA, 632 bp, Homo sapiens
  misc_feature: GZ8MTXP02HECPF.11.71.G05.1.454.CMB.2.raw
  modified_base (295)..(295): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggaggtccctgagactctcctgtacagcctctggccttcaccttcacttaccctatggcatgcactcgggtccnccagacctccgaggcgagggggctgggaggtggggtggctagtttattcatatgataggtaaatagtgtacttctattcagtactccggtaggaacgggctattacccaccgttcctaccgagtacgactaacgttccacggacctacgaccggtctagttatccttagacctaaaagtcgaaacgacgtaccgtaggacggaacgcgtaggacggacgacggtctaggttagttaaacgtttacgtaggttacgaaaccggttaaagttaacgttttaacgtaaaggttaacgggtagggttacggtaccgggttaacggggggttcctttaccgg

SEQ ID NO: 410320 - DNA, 631 bp, Homo sapiens
  misc_feature: GZ8MTXP02HXH2U.11.71.G05.1.454.CMB.2.raw
  modified_base (246)..(246): a, c, t, g, unknown or other
  modified_base (294)..(294): a, c, t, g, unknown or other
  modified_base (337)..(337): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaatggaggagtcgtgggggagcgtggtccagccgtgggagtccctgagactctcctgtacngcctctgtcttcaccttcattaccctatggacatgcacgtcgggtccncagacctccgaggcgaggggctgggagtgggtgctagttattnatatgataggaaatgtgtacttcgtattcgagtaccgtcgtaggaacgggtcctaattcccacccgtcctaccgagaacgaactacttaccgaggacaccgacgtcgttagtacttcgtacgtaactaaaagtacggaaacacggtacccgtaggaaggacgtcggtaagggacggaaccgaacggtcgttaggttacgttaacgttagttaggtacgtaacgtaaagttacgtttaagttaaagtaacgggtaagggtacgtaaccggggttaccgggggttacgtttaccgg

SEQ ID NO: 410321 - DNA, 564 bp, Homo sapiens
  misc_feature: GZ8MTXP02I786B.11.71.G05.1.454.CMB.2.raw
  modified_base (247)..(247): a, c, t, g, unknown or other
  modified_base (264)..(264): a, c, t, g, unknown or other
  modified_base (270)..(270): a, c, t, g, unknown or other
  modified_base (286)..(286): a, c, t, g, unknown or other
  modified_base (327)..(327): a, c, t, g, unknown or other
  modified_base (330)..(330): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaatggaggagtcgtgggggagcgtggtccagccgtgggacgtccctgagactctcctgtacngcctgtgcttcaccttnattacntgcatgcacgtggccncagctcgaggcgaggggctggaggtgggtgctagtttattnatntgataggaaaatgtatacttactattcgaagtacctcggtagaacgggtccatttccgacccgtctaccagaacgaactaataccgagcaacacgacgtatactactagaactaaatacgaaacagacctagacgagacgagaagacgacgtgtagtagtacttagtacgtacgtaactaaaagttagttaacgtaagtaaggtaggtacggtaacggtacggggtacgtttag

SEQ ID NO: 410322 - DNA, 554 bp, Homo sapiens
  misc_feature: GZ8MTXP02J2KGG.11.71.G05.1.454.CMB.2.raw
  modified_base (293)..(293): a, c, t, g, unknown or other
  modified_base (323)..(323): a, c, t, g, unknown or other
  modified_base (401)..(401): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctggggaggtccctgagactctcctgtacagcctctggccttcaccttcattacccatggcatgcactgggtcccncagctccgaggcgaggggctgggagtgggngctagttattacgatatgactaggaaatgtgacttctatcagtactccgtagaacgggccattccaccgtctccaganacaatccgagaccacacgctagtactactcgacaatacgaacacgtacctgaacgagtcgaggacggacacggtcgtgttaggtattacgtcgttagacgtaaagttatttaacgtagtaggtacgttaggacggtaacggggtcctttacgg

SEQ ID NO: 410323 - DNA, 589 bp, Homo sapiens
  misc_feature: GZ8MTXP02JUMHT.11.71.G05.1.454.CMB.2.raw
  modified_base (267)..(267): a, c, t, g, unknown or other
  modified_base (316)..(316): a, c, t, g, unknown or other
  modified_base (348)..(348): a, c, t, g, unknown or other
  modified_base (377)..(377): a, c, t, g, unknown or other
  modified_base (488)..(488): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccaggccgtgggacgtccctgagactctcctgtacngcctcgtgcttcaccttcattacctatcggcatgctacgtcgggtcccncagacctccgaggcgaggggctgggagtgggngctagttattcattatgataggaattgtntactttctattcagtcgtcgtagaacggtccgtacttccaccgtctacccgagaacgaactacgttccgaacggaccacgacgtctagtactcctagacaaagtcgaaacncgtacctagaacgtacgacgtagggaacggacgaacggtcgttaggtacgttacgttaagtaggtacgtaacgtaaagtttacgtttacgtaaggtaaggg

SEQ ID NO: 410324 - DNA, 596 bp, Homo sapiens
  misc_feature: GZ8MTXP02HX6QD.11.71.G05.1.454.CMB.2.raw
  modified_base (269)..(269): a, c, t, g, unknown or other
  modified_base (275)..(275): a, c, t, g, unknown or other
  modified_base (314)..(314): a, c, t, g, unknown or other
  modified_base (342)..(342): a, c, t, g, unknown or other
  modified_base (376)..(376): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttccctcgttgcttcttttaagaggtgtccagtgtcaggtgcaacgtggaggagtcgtgggggaggcgtggtccagccgtggggacgtccctgagactctcctgtacngcctcnggcttcaccttcattacctatggcatgcacgtgggcccnccagacctccgaggcgagggggctgggngtggggtgctagtttattcatatgatggaatgtntactttctattcagtacctccgtaggaacgggccgtacgttccacccgttcctacccgagaacgacctaacgttccgaaggccaacgacgtcttagtacttcctagaacctaaatacgaacgacgtaccgtaggaacgacgacgtaggaacggaccgtacggtccgttacgtagttaagttaacgtggtacgaacggtaaatacttttacgtaagtaagg

SEQ ID NO: 410325 - DNA, 586 bp, Homo sapiens
  misc_feature: GZ8MTXP02GWPH3.11.71.G05.1.454.CMB.2.raw
  modified_base (199)..(199): a, c, t, g, unknown or other
  modified_base (310)..(310): a, c, t, g, unknown or other
  modified_base (570)..(570): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtncaactggaggagtcgtgggggaggcgtggtccagccgtgggagtccctgagactctcctgtacagcctctggcttcaccttcattacctatggcatgcacgtcgggtcccnccagtacctccgaggcgagggggctgggagtggggcggactaggtttatttcgaatagtagagtagggtaatgtgtactttacgtattcgagtaccgtcgtagaacgggtcctaacgttccacccgtctaccgaagtacgaacctaacgttccgaacggaccaacgacgtctagttactctagacaaaatcgaacagtccagagacgcgtaggacgacgacggtctacggtgttaacgtaacgtgtacgtactaaagttntttacgtaagtaacgg

SEQ ID NO: 410326 - DNA, 536 bp, Homo sapiens
  misc_feature: GZ8MTXP02JZ161.11.71.G05.1.454.CMB.2.raw
  modified_base (250)..(250): a, c, t, g, unknown or other
  modified_base (256)..(256): a, c, t, g, unknown or other
  modified_base (296)..(296): a, c, t, g, unknown or other
  modified_base (326)..(326): a, c, t, g, unknown or other
  modified_base (341)..(341): a, c, t, g, unknown or other
  modified_base (352)..(352): a, c, t, g, unknown or other
  modified_base (370)..(370): a, c, t, g, unknown or other
  modified_base (407)..(407): a, c, t, g, unknown or other
  modified_base (418)..(418): a, c, t, g, unknown or other
  modified_base (496)..(496): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtgggaggagtcgtgggggagcggtggtccagccgtgggacggtccctgagctctctgtacngtcctntgcttcaccttcattacctatggcatgcacgtcgggtccncagcctccgaggcgaggggctggagtgggngctagttattcatangatgaaatgtntattctatcagtactcgngagcgtattcaccgtctcgagacacaactcaggcacncgctagtactntacgacaagtacgaacgacgcctaggacgagcgtagacgacgacggcgtagtgtacttacgtgtacgacgtaaagttnttaagtacgtaggtaggtcgacggttacggggcgtttacg

SEQ ID NO: 410327 - DNA, 634 bp, Homo sapiens
  misc_feature: GZ8MTXP02H7LGK.11.71.G05.1.454.CMB.2.raw
  modified_base (252)..(252): a, c, t, g, unknown or other
  modified_base (258)..(258): a, c, t, g, unknown or other
  modified_base (299)..(299): a, c, t, g, unknown or other
  modified_base (360)..(360): a, c, t, g, unknown or other
  modified_base (367)..(367): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtggggggaggcgtggtccaggccgtggggacgtccctgagactctctgtacngtcctntgtcttcaccttcattacctatggcatgcacgtcgggtccnccagcctccgaggcgagggggctggagtgggtgctagttattcatagtgataggaaatgtntactttntattcgagtactcggtagaacgggcctattcccgaccgtcaccgagacgaactaacttccgaggtccaacgaccgtctagttaaactccgttagaacctaaaatacgaaacgacgacccgtaggagacgacgtaggaacggtaaccgaaccgggttcgtaggtttacgttaacgttacgtacggtacgtaaacgttaaacgttacgtttaacgtaaggtaacggtaacgggttacggtaaccggggttacggggttaccgtttacgg

SEQ ID NO: 410328 - DNA, 575 bp, Homo sapiens
  misc_feature: GZ8MTXP02GN11B.11.71.G05.1.454.CMB.2.raw
  modified_base (182)..(182): a, c, t, g, unknown or other
  modified_base (264)..(264): a, c, t, g, unknown or other
  modified_base (269)..(269): a, c, t, g, unknown or other
  modified_base (291)..(291): a, c, t, g, unknown or other
  modified_base (309)..(309): a, c, t, g, unknown or other
  modified_base (383)..(383): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagnggtgtccagtgtcaggtgcaacgtgggaggagtcgtgggggagcgtggtccagccgtgggagtccctgagctctcctgtacngcctntcgcttcaccttcattacctanggcatgcacgtcggtccnccagcctccgaggcgagggggctgggaggtggggtggctaggtttatttcatagtgatagggaatgtgactttntattcagtactcgtagaacggccgaattccgaccgtcctaccaagacaactattaccacggcaacacgtctagtactctagaacaaagtacgaacacgcctagaacggagacgtaggacggaaccgcggtaccgtcggttagttacttaagtggtaacgaacgggtaaaataacgtttactaaagtaagggg

SEQ ID NO: 410329 - DNA, 612 bp, Homo sapiens
  misc_feature: GZ8MTXP02FNHAV.11.71.G05.1.454.CMB.2.raw
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctggggaggtccctgagactctcctgtacagcctctggcttcaccttcattaccctatggcatgcactgggccnccagcctccgaggcgaggggctggagtgggtgctagttatttcatagtgataggaaatgtgtaacttcttattcaagtaccgttccggtaggaacggggcctattcccacccgttctacccagaacgaactaaacttcccgagggaccaacgtaccgactcgtatcgtagaactaaatagaaaccacgtacctaggacgaggcgtaggaaggaccgacggtcgtaggttgttaagttacgtacggttacgaacgtaaagttagtttaacgttaaagtaacggtagggttaggtaaaccggtacgggggtacttttaccggg

SEQ ID NO: 410330 - DNA, 630 bp, Homo sapiens
  misc_feature: GZ8MTXP02H4ZQ9.11.71.G05.1.454.CMB.2.raw
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttctttaagaggtgtccagtgtcaggtgcaacgtggaggagtcgtgggggaggcgtggtccaggccgtgggacggtccctgagactctcctgtacagcctctggccttcaccttcattaccctatggcctagtgcctacgtcggggtcccacagacctccgaggcgagggggctgggacggtggggtgctagttattcatagtgagtagggaatggtatactttctaatcgagtacctccgtagacggtcccgtattcccgaccgttctaccgaagtaacgaactacttaccgacggactaaccgacggtctaggtactactacggaaactaaacgttacggaaaccacgtaccgtagaacggtagaccgtggaaacggaccgacgggtactacggtagttaaacgttaaccgtcggtaaggtaaccgtaaaagtttacgtttacttaaaggtagggg

SEQ ID NO: 410331 - DNA, 594 bp, Homo sapiens
  misc_feature: GZ8MTXP02GEH2U.11.71.G05.1.454.CMB.2.raw
  modified_base (291)..(291): a, c, t, g, unknown or other
  modified_base (327)..(327): a, c, t, g, unknown or other
  modified_base (362)..(362): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggaggtccctgagactctcctgtacagcctctggcttcaccttcattacctatggcatgcacgtggggtccnccagacctccgaggcgagggggctgggaggtggggnggctagttattcatatgataggaaatgtgtacttntattcgagtactcgtagaacgggcctattccaccgtctccagacgacaacttccaggacaacgacgtctgtactctagactaaatagaaacacgcccgtagacgagtacgtggaacggacgacgggtactaggttagttacgtttacgtacggtacggtacggtaaaagttagtttaaccgtaagttaaggtacggggttacgtaaccgggttacggggggtactttacggg

SEQ ID NO: 410332 - DNA, 560 bp, Homo sapiens
  misc_feature: GZ8MTXP02JTR25.11.71.G05.1.454.CMB.2.raw
  modified_base (305)..(305): a, c, t, g, unknown or other
  modified_base (369)..(369): a, c, t, g, unknown or other
  modified_base (374)..(374): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcgtgggttttcctcgttgcttcttttaagaggtgtccagtgtcaggtgcaactggaggagtcgtgggggaggcgtggtccagccgtgggacgtccctgagactctcctgtacagcctctggcttcaccttcattacctatggcatgcacgtgggtcccnccagacctccgaggccgaggggctgggagtggggtgctagttattcgatatgataggaaatgtnacttntattcagtactcgtaggaacgggcctatccaccgtctccagacgacactccgagcacgacgctgtactctagactaaaagtcgaaacgacgtccgagagagtaccgtaggaacggacgacggtctgtagttacttacgtcgtagagtaaaagttcttacgagtaggtacggtacggtacggtcggg

SEQ ID NO: 410333 - DNA, 536 bp, Homo sapiens
  misc_feature: GZ8MTXP02JER30.11.71.G05.1.454.CMB.2.raw
  modified_base (181)..(181): a, c, t, g, unknown or other
  modified_base (199)..(199): a, c, t, g, unknown or other
  modified_base (309)..(309): a, c, t, g, unknown or other
  modified_base (335)..(335): a, c, t, g, unknown or other
  modified_base (342)..(342): a, c, t, g, unknown or other
  modified_base (354)..(354): a, c, t, g, unknown or other
  modified_base (357)..(357): a, c, t, g, unknown or other
  modified_base (407)..(407): a, c, t, g, unknown or other
  modified_base (423)..(423): a, c, t, g, unknown or other
  modified_base (427)..(427): a, c, t, g, unknown or other
  modified_base (434)..(434): a, c, t, g, unknown or other
  modified_base (448)..(448): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtncaactggaggagtcgtgggggagcgtggtccagccgtggggagtccctgagactctcctgtacagcctctggcttcaccttcattaccatggcatcgcagtcgggtcccncagactccgaggcgagggggctgggngtggggngctagtttattnatntgatgggaatgtgtacttcgtattcagctcgtgaacggctatcaccgtcnccagagacatcagcanacgntgatcgngacaaatcgaaacnggacctagacacggtctaggacggtacacggtctagttacgtaattaacgtggttaacgacgtaaaagttatttacgaagtttaaggg

SEQ ID NO: 410334 - DNA, 644 bp, Homo sapiens
  misc_feature: GZ8MTXP02HDBAR.11.71.G05.1.454.CMB.2.raw
  modified_base (247)..(247): a, c, t, g, unknown or other
  modified_base (293)..(293): a, c, t, g, unknown or other
  modified_base (338)..(338): a, c, t, g, unknown or other
  modified_base (362)..(362): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccagccgtgggagtccctgagactctcctgtacngcctctggcttcaccttcattaccctatggcatgcacgtgggtccnccagacctccgagggcgaggggctggaggtgggtgctagttattnatatgataggaaatgtgtactttnattcgacgtactccggaggtaacggggcctattcccgaaccgtctaccgtaagacgaactaacgttacgacggcaaccgtaccgtaccgttagtacttccgtaggtacctaaaagttacgaaaccgtacgtacccgttaaggacggaacggaccgtagggaacggacgtaccgggtacgtacggttagttacgttaacggttaggtacggtaaccgtaaaggtttacttaacgttagtaacggtagggtacggtaaccgggtacgggggtcgttttaaccgg

SEQ ID NO: 410335 - DNA, 566 bp, Homo sapiens
  misc_feature: GZ8MTXP02HJZDM.11.71.G05.1.454.CMB.2.raw
  modified_base (250)..(250): a, c, t, g, unknown or other
  modified_base (255)..(255): a, c, t, g, unknown or other
  modified_base (268)..(268): a, c, t, g, unknown or other
  modified_base (295)..(295): a, c, t, g, unknown or other
  modified_base (326)..(326): a, c, t, g, unknown or other
  modified_base (341)..(341): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgctcttttaagaggtgtccagtgtcaggtgcaacgtggaggagtcgtgggggaggcgtggtccagccgtgggacggtccctgagactctcctgtacngcctntggcttcaccttnattaccatggcatgcacgtcgggtccncagcctccgaggcgaggggctggaggtgggngctagttattcatangataggaaatgtgtacttcgtattcgagtactcgtaggacggtcattccaccgtctaccgagtacgactactacgagaccacgacgtctatacgtctgactaaagtgaacagcctagagagcgtaggacgacgcggtactgtagtacgttacgtacggtagaacgtaaagttagtttaacgtaagttacggtaggttacggacgggttaccggggtcgtttacgg

SEQ ID NO: 410336 - DNA, 741 bp, Homo sapiens
  misc_feature: GZ8MTXP02J1ZOZ.11.71.G05.1.454.CMB.2.raw
  modified_base (273)..(273): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtgggaggaggtcgtgggggaggcgtggtccaggccgtggggacggtccctgagtactctcctgtacncgtcctcgtggccttccaccttcaactttaccctagtcggacctagttcggcctacggttcggggtccccaccgaggacccgtccggaaggggccggaacgggggggtcctagggggaggggttcgggggtcgggtacttaacggttttactttacgaagtttagtggaaagttaggggtaaagttggttaacgtacctttacttaactttaccgaaacggtcccgtaccggtagggtaaacggggtacccgtacgttacccgaaccgttcccgtacccgaagtaacgaaccgtaacgttacccgaacggtacccaccgaccgtacgttacgtacgttacgtacgaaccgtaaatacgaaacgtacgaccgtagacgacgtcgaggacggtacgtacggtacgttacggttagttaacgttaacgttaggtacgtaacggtaaacgttacgtttacgtaagtaacggg

SEQ ID NO: 410337 - DNA, 600 bp, Homo sapiens
  misc_feature: GZ8MTXP02GFRSR.11.71.G05.1.454.CMB.2.raw
  modified_base (247)..(247): a, c, t, g, unknown or other
  modified_base (252)..(252): a, c, t, g, unknown or other
  modified_base (262)..(262): a, c, t, g, unknown or other
  modified_base (268)..(268): a, c, t, g, unknown or other
  modified_base (286)..(286): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagcctgggacgtccctgagactctcctgtacngcctntgctcacttnataccntgcatgcacgtgggtccncagcctcgaggcgaggggctgggagtgggtgctagtttattcatagtgacgtaggtaaatgtgtactttctattcgaacgtaccttccggtaggaaacgggtcctaattccgaacccgtctacccgaagaacgaactaacttaccgacggaccaacgtacgtactacgtactacgtaggaactaaagtacgaaacgacgaccgtaggagacgtacgaggacggacgacggtcttaggttagttacttacgtcgttacgaacgtaagtatttaagtaagtacggtaggtacggtacggttacggggtctttacgg

SEQ ID NO: 410338 - DNA, 676 bp, Homo sapiens
  misc_feature: GZ8MTXP02I4KNV.11.71.G05.1.454.CMB.2.raw
  modified_base (249)..(249): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgttgggttttcctcgttgcttcttttaagaggtgtccagtgtcaggtgcaacgtggaggagtcgtgggggagcgtggtccagccgtgggagtccctgagtactctctgtacngcctgtggtcttcaccttcacttacctatggctatcggacctacgtcggggtccccaccaggtacctccggaggcgaggggggctggggtaggtggggtacggacttagtttacttcgaattagtaggaagttaaggaaattggtagttaactttcttaagttccgaacgtaccgttaccggtagggaaaccggggtcctaatttcccgacccgttctaccaagtaacgaactaactaccgacggaccaccgaccgtacgttacgtatccgtagaacctaaagtacgaacgtacgaccgtaggagtacgacgtaggaacggtacgacggtcgttaggttacttaggttacgtggttaacgaacggttaaattacgttaagtaacgtacggtagggtacggtaaccgggttacgggggttctttacgg

SEQ ID NO: 410339 - DNA, 539 bp, Homo sapiens
  misc_feature: GZ8MTXP02FU4O0.11.71.G05.1.454.CMB.2.raw
  modified_base (245)..(245): a, c, t, g, unknown or other
  modified_base (250)..(250): a, c, t, g, unknown or other
  modified_base (287)..(287): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctcctgtacngcctntggcttcaccttcattacctatgcatgcacgtggccncagactccgaggcagggggctgggagtgggtgctagtttattcatatgatggaaatgtgacttctattcagtactcgagaacgggcattccaccgtctccgagagacaatccaggcacacgctgtactctagacaaatcgaaacagcctaggagagacgagaggacgacggtctgtagttacttacgtaggtacgaacgtaaagtatttaacgtaagtaggtacggtcgtaacggtacgggggtctttacgg

SEQ ID NO: 410340 - DNA, 562 bp, Homo sapiens
  misc_feature: GZ8MTXP02JP3TI.11.71.G05.1.454.CMB.2.raw
  modified_base (292)..(292): a, c, t, g, unknown or other
  modified_base (334)..(334): a, c, t, g, unknown or other
  modified_base (359)..(359): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtggggagtccctgagactctcctgtacagcctctggcttcaccttcattacctatggcatgcacgtgggtccnccagacctccgaggcgaggggctgggagtgggtgctagtttnttcatatgatggaaatgtgtacttntattcagtactccggtagaacggggtcctattcccaccgtctaccagacgactaactccgacggacacgacgctagtactctagactaaatgaaacacgccgtagagcgctaggaacggacgaggtctggttagtacttacgtggtacgacgtaaagtatttaacgtagtacggtaggtagtaccggtacggggtctttacgg

SEQ ID NO: 410341 - DNA, 631 bp, Homo sapiens
  misc_feature: GZ8MTXP02JW23D.11.71.G05.1.454.CMB.2.raw
  modified_base (300)..(300): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggaggcgtggtccagccgtgggacggtccctgagacctctcctgtacagcctcgtggccttcaccttcattaccatggcatgctacgtcgggtccncagcctcgaggcgaggggctgggagtgggtgctagtttattcatagtgaagtaggtaaatgtcgtactttctattccgagtacctccggtagaacgggctattcccgaccgtctaccagacgactaacgtccgaggaccacgacgtctagtactcgtagaaccaaagtacgaaacgtacgaccgtaggaagacgcgtaggacggtaccgacggtcgttacggttagttaacgtttaccgtaggtacgaaccggttaaaagttacgttttaacgtaagttaagggtacgggttacggtaccggggtttaccgggggttacttttacccgggg

SEQ ID NO: 410342 - DNA, 581 bp, Homo sapiens
  misc_feature: GZ8MTXP02G3MPS.11.71.G05.1.454.CMB.2.raw
  modified_base (183)..(183): a, c, t, g, unknown or other
  modified_base (266)..(266): a, c, t, g, unknown or other
  modified_base (271)..(271): a, c, t, g, unknown or other
  modified_base (312)..(312): a, c, t, g, unknown or other
  modified_base (346)..(346): a, c, t, g, unknown or other
  modified_base (357)..(357): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagnggtgtccagtgtcaggtgcaacgtgggaggagtcgtgggggagcgtggtccagccgtgggacgtccctgagctctcctgtacngcctntggcttcaccttcattacctatggcatcgcacgtcgggccnccagactccgaggcgagggggctgggagtggggngctagtttatnagtatgagtagaattgtagtacttactattcgagtacctccggtagaaacggcctacgttccgacccgtctaccgaagtacgaactaacgttccgagaccaacgacgtcgttagtactactacgaactaaagtacgaaacacgtccgtagaacgtacgacgaggacggacgacggtctacgtacgttataacgtgtacgacgtaaacgtatttacgtaagtagg

SEQ ID NO: 410343 - DNA, 611 bp, Homo sapiens
  misc_feature: GZ8MTXP02ITTT9.11.71.G05.1.454.CMB.2.raw
  modified_base (182)..(182): a, c, t, g, unknown or other
  modified_base (258)..(258): a, c, t, g, unknown or other
  modified_base (263)..(263): a, c, t, g, unknown or other
  modified_base (268)..(268): a, c, t, g, unknown or other
  modified_base (313)..(313): a, c, t, g, unknown or other
  modified_base (498)..(498): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagnggtgtccagtgtcaggtgcaactggaggagtcgtgggggagcgtggtccagcctggggacgtccctgagctctccngtacngcctntgcttcaccttcattacctatcggactatgctacgtcgggtcccnccaagcctccgagggcggagggggctggggagtggggtgacctagtttattcgaattagtgagtaggaaattgtagtaacctttctattcgaagtcccgttaccgtaggaacggtaccgtacgttaccgaacccgtctacccagtaacgaacgtaacttccgaggtacaacgacgtctagttacncgtagactaatacgaacacgacgtagacgacgtacgacggacgaaccgacggtaccgttagtacggttaacttaacgtagtacgtaacgtaaagttactttacgtaaagtagg

SEQ ID NO: 410344 - DNA, 644 bp, Homo sapiens
  misc_feature: GZ8MTXP02IL4E7.11.71.G05.1.454.CMB.2.raw
  modified_base (252)..(252): a, c, t, g, unknown or other
  modified_base (299)..(299): a, c, t, g, unknown or other
  modified_base (325)..(325): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagtcttgggttttcctcgttgcttcttttaagaggtgtccagtgtcaggtgcaacgtggaggagtcgtggggggaggcgtggtccaggccgtgggacgtccctgagactctctgtacngtcctctgtcttcaccttctattacctatggcatgctacgtcggccncagacctccgaggcgaggggctgggnggtgggtgctagtttattcatagtgtagtaggaaattggtctactttacgtattcgaagtaccgttccggagtaaccggggtcctaatttcccacccgttcgtaccgaagtaacgtaacctaacgttaccgaacggacctaaaccgacgtacttaggttacttaccgtagaaacccgtaaatacggaaacctacgccgtagaggacgacgtaggacggaacgtaccggtgttacgttagtttaactagtacgtaacgtaacgtaaagttactttaagtaagtacggtaggtagtaccgggttacggggttactttacgg

SEQ ID NO: 410345 - DNA, 699 bp, Homo sapiens
  misc_feature: GZ8MTXP02FZ70U.11.71.G05.1.454.CMB.2.raw
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtggggaggtccctgagactctcctgtacagcctctggcttcaccttcattacctatggcatgccacgtcgggtcccgccagtacctccgaggccgaggggggctggggtaggtggggtggctaggtttatttcgattagtagagtaggaaaacgttgtagtactttactaatttccgacgtaacttacccggtagggtaaacggggtcccgtaattcccgaacccgttcttacccgaagaacgtaacctaagttcccacgggaccaacgtaaccgtccgttaggttaaactccttaggaacctaaaagttacgaaaaccgaggacccgtaggaaggacgtaccggtagggaacggaccgtaaccggggcttagggttacggttaactttaccggtaggttacgaaacggttaaaagtttagtttaaccgtaaggtaaacggtagggtacggtaacgggtacgggggtttccgtttaacgg

SEQ ID NO: 410346 - DNA, 588 bp, Homo sapiens
  misc_feature: GZ8MTXP02ICIEN.11.71.G05.1.454.CMB.2.raw
  modified_base (251)..(251): a, c, t, g, unknown or other
  modified_base (268)..(268): a, c, t, g, unknown or other
  modified_base (295)..(295): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggaggtcgtggggggaggcgtggccagccgtgggacggtccctgagctctcctgtacngcctctgcttcaccttnattacctatgcatgcacgtcgggcccnccagacctccgagggcgagggggctggggaggtggggtagctagttattcatagtgagtaggaaattgtctacttctattcaagtctcggagacgggctattccacctcacagacgacatccgagcacgacgcgtgttactctagaaccgtaaagtacgaaacgtcgacccgtaggaacgacgcgtaggaacggacgaaccggtcgtagttacgttaattacgtgtacgaacggtaaattagtttaacgtaaggtaaggtagggtacggaccggttacggggtacgtttacgg

SEQ ID NO: 410347 - DNA, 593 bp, Homo sapiens
  misc_feature: GZ8MTXP02HDST1.11.71.G05.1.454.CMB.2.raw
  modified_base (265)..(265): a, c, t, g, unknown or other
  modified_base (320)..(320): a, c, t, g, unknown or other
  modified_base (371)..(371): a, c, t, g, unknown or other
  modified_base (390)..(390): a, c, t, g, unknown or other
  modified_base (445)..(445): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggaggcgtggtccagccgtgggacgtccctgagctctctgtacngcctctggtccttctaccttctacttaccctagtggctatgcacgtcgggtcccnccagctccgaggccggaggggctgggagtggggtgctagtttattcattangtataggaatgtctacttntattcgagtactcgtagacggctatcaccgtctccgagacactactcgagcaacncgtctagtactcagtacaaatacggaactagaccgtagaacgtacggtacgtagggaaccggaaccgtcgggtaccgttacggttagtttaaacgttccgttaggtacggtaaacgtaaaagtttaccgtttacgtaaaggtaagggg

SEQ ID NO: 410348 - DNA, 615 bp, Homo sapiens
  misc_feature: GZ8MTXP02HFBKZ.11.71.G05.1.454.CMB.2.raw
  modified_base (292)..(292): a, c, t, g, unknown or other
  modified_base (327)..(327): a, c, t, g, unknown or other
  modified_base (347)..(347): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggtttcctcgttgctctttaagaggtgtccagtgtcaggtgcaactggaggagtcgtgggggagcgtggtccagcctgggagtccctgacgactctcctgtacagcctcgtggccttacacccttcacttaccatggcatgcacgtgggtccncagctcgaggcgaggggctggagtggtgctagttnttcatatgaatagaaattgngtacttcgtattcgaacgtactccggtagaacgggtcctaatttcccaaccgttcacccgaagacgtaactaacgttccgaggacctacgacgtccgttagtaactctagactaaaagtcgaaactagcccttaggagcgtacgtaggaacggacgacgggttcctaggttagtaacgtttaccgtgggtacgtaaccgtaaaagtttccgttaacgtaaagtcgggttaaggtaccggtacggttaaccgggggtcttttaaccggg

SEQ ID NO: 410349 - DNA, 621 bp, Homo sapiens
  misc_feature: GZ8MTXP02HU7PW.11.71.G05.1.454.CMB.2.raw
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggtttttcctcgttgctcttttaagaggtgtccagtgtcaggtgcaacgtggaggagtcgtgggggaggcgtggtccaggccgtggggaggtccctgagactctcctgtacagcctctggcttcaccttcattacctatggcatgccacgtgggtcccgccagacctccgaggggaaggggctgggagtggggtgcgtagttatttcgatagtgataggaaattggtgtactttactagtttcagtaccgtcccggtaggaaacggggtcccgtatttccgacccggttcttacccgaagacgtaacctaaacgttcccgaagggccctaacgaccggtctttaggtacttcgtacgacctaaaagtcgaaacgacgccgtagacgagcgtaggacggacacggacttggtagttacttacgtggtacgtaacgtaaaagtttctttacgtaagttacggtacgg

SEQ ID NO: 410350 - DNA, 673 bp, Homo sapiens
  misc_feature: GZ8MTXP02JD580.11.71.G05.1.454.CMB.2.raw
  modified_base (317)..(317): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcggtgggggagcgtggtccaggccgtgggagtccctgagctctcctgtacacgcctgtcggccttacaccttcattacctagtggctatgcacggtcggtccnccagactccgaggccggaggggctggggaggtgggtcggtactagtttattacgattagtgtaagtagggtaattgtacgttacctttactatttcgaacgttaccgttaccgggtaggtaaaccggggtacccgttaacgttcccgtaacccgtttaccgaccccgtaaaggtaaccgtaaccttaaaccgttacccggaacgtacccgaaaccgtacccgtagtacgttacttacgtacgaacctaaaagtacgaacgacgtaccgtagaacgtacgacgtaggaaccggacgacggtctagttcgttagtaacgtaggtaacgtaacgtaagttactttacgtaaggtaaggg

SEQ ID NO: 410351 - DNA, 624 bp, Homo sapiens
  misc_feature: GZ8MTXP02G1PP4.11.71.G05.1.454.CMB.2.raw
  modified_base (307)..(307): a, c, t, g, unknown or other
  modified_base (536)..(536): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggaggtccctgagactctcctgtacagcctctggcttcaccttcattacctatggcatgcacgtgggtccncagctccgaggcgagggggctgggagtggggtggctaggtttattcgattagtgtagtagggtaattggtgtacctttctaagtttcgaagtacccgttacccggtaggaaacggggtcccgtaacgttacccgacccggttacctaccccgaaggtaacgaaaccgtaacgtttcccgaaggaccctaacgaccggtcctaggtactcgtacgacaaagtagaaaccngaccgtgaacggacgacggtacgacggaccgacggtcgtcgttagtacttaacgtgtacggtacgtaaaatcgtttacgagttaaggg

SEQ ID NO: 410352 - DNA, 676 bp, Homo sapiens
  misc_feature: GZ8MTXP02GL85B.11.71.G05.1.454.CMB.2.raw
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccagccgtggggaggtccctgagactctcctgtacagcctcgtggcttcaccttcattacctatggcatgcacgtgggtccaccagacctccgaggcgaggggctgggaggtggggtgctaggtttattcatatgagtaggaaattgtgtactttctattcgagtaccgttccggtaggaaaccggggcccgtaatttcccgacccgttccgtaacccgaacggtaacgaaacctaaacgtttacccgaacgggaccaacgtacgacgttacggttaactcctaggaaccaaaattacggaaacgtacgaccccgttagggaacgacggaccgtagggacgggacccgtaacgggtcgttggttacgttaacgtttaccgtaggtacggtaaccgtaaagttacgtttaacgtaagtagggtacgggtacggtaccgggttacgggggttacgttttaccggg

SEQ ID NO: 410353 - DNA, 657 bp, Homo sapiens
  misc_feature: GZ8MTXP02H1LY6.11.71.G05.1.454.CMB.2.raw
  modified_base (246)..(246): a, c, t, g, unknown or other
  modified_base (264)..(264): a, c, t, g, unknown or other
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggagtcctgagactctcctgtacngcctctgccttcaccttnattaccatggcatgcacgtgggtcccncagacctccgaggcgaggggctgggagtgggtgctagtttattcatagtgagtaggaaattgtacgtactttctattcgaagtaccttccggtagaacggggtcctattcccgacccgtctacccgagtacgaactaacgttaccgacggaccaacgacgtccgttagtaacttcgtacgtaactaaaacgtacgaaaccgtacggacccgtaggaacggaacggtacgtaacgggaacgggaaccgacgggtacgttaggttagtttaacttacggttaggtacggtaaacgtaaaagttacgtttaacgtaaggttaacggtacggggtacggtaaccggggttacgggggttacgtttacggg

SEQ ID NO: 410354 - DNA, 653 bp, Homo sapiens
  misc_feature: GZ8MTXP02G64UF.11.71.G05.1.454.CMB.2.raw
  modified_base (265)..(265): a, c, t, g, unknown or other
  modified_base (313)..(313): a, c, t, g, unknown or other
  modified_base (342)..(342): a, c, t, g, unknown or other
  modified_base (352)..(352): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggttgtccagtgtcaggtgcaactgggaggagtcgtgggggagcgtggtccagccgtgggacgtccctgagctctctgtacngcctctggcttcaccttcattaccctatggcatgcctacgtcggtccnccagacctccggaggcgagggggctgggnggtgggtcgntaggtttattcatagtgagttaggaactgtcgtacttcttatcgaaactccgtccgtaggacggtaccgtacttaccgaccgtctacccgaagtacgaaccgtacgttaccgacggtaccaaccgtacgtccttaggttacttaccgagtaaaccctaaagttacgaaacccgtaggtacccgtaggaacgaacggtcgttaggaacgggtaaacgtaccgggttccgtaggttacgtttaaagttaacggttaggtaccggtaacgtaaagtttaccttttacggtaacgtttaaagggg

SEQ ID NO: 410355 - DNA, 683 bp, Homo sapiens
  misc_feature: GZ8MTXP02JWV4P.11.71.G05.1.454.CMB.2.raw
  modified_base (295)..(295): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggaggtccctgagactctcctgtacagcctctggccttcaccttcattacctatggcatgcacgtcgggtcccnccagacctccgaggcggaggggctgggaggtggggtggctagtttattacatagtgaagtaggaaattagtacgtactttacttaattccgagaccgttccggtaggaaccggggtcccgtaagttccctacccgttacccgtacccgaacgtaacgaaccctaaacgtttaccgacggtaccaaccgaccgtacttacgtacttcgtacgactaaacgtacgaaaccgacgtaccgtacggaacggacggacgtacggaacggaccgacgggtacgttcggttagtttacgtttaacgttggttacgtaacggtaaaagttaacttttaacgttaaagttaacggtagggtacgggtaaccggttacggggggtacggttttaccgg

SEQ ID NO: 410356 - DNA, 580 bp, Homo sapiens
  misc_feature: GZ8MTXP02GZMRC.11.71.G05.1.454.CMB.2.raw
  modified_base (184)..(184): a, c, t, g, unknown or other
  modified_base (292)..(292): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtncaactggaggagtcgtgggggagcgtggtccagccgtgggacgtccctgagactctcctgtacagcctctggcttcaccttcattacctatggcatgcacgtcggccncagacctccgaggcgaggggctggaggtgggtgctagtttattcaatagtgaataggaaaacttgtacgtactttactattcgacgtactccggtagaacgggtcctattcccaccgtctaccagacgactaactcgacgacaacacgctagtatctagaactaaatacgaacacgaccagacgacgcgacggaacgacgacggtcgttagtagttaacttacgtacgtacgtaacgtaaagttattaacgtaagtacggtaggtacgtacggttacggggctttacg

SEQ ID NO: 410357 - DNA, 566 bp, Homo sapiens
  misc_feature: GZ8MTXP02JZIDU.11.71.G05.1.454.CMB.2.raw
  modified_base (376)..(376): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacagcctctggcttcaccttcattacctatggcatgcacgtgggtcccgccagacctccgaggcgagggggctgggagtggggtggctagttattcatatgataggaatgtgtacttntattcagtactccgtagaacggccgtattccaccgtctaccagacgaactaacttccgaaggccaacgacgtctacgtactcgtagactaaaatcgaaacacgcctagaagacgacgtaggacggaccgacggtcgttagtacgttattccgtagtacgtacgtaaaaggttctttacgtagttaacggg

SEQ ID NO: 410358 - DNA, 564 bp, Homo sapiens
  misc_feature: GZ8MTXP02IWKX6.11.71.G05.1.454.CMB.2.raw
  modified_base (265)..(265): a, c, t, g, unknown or other
  modified_base (312)..(312): a, c, t, g, unknown or other
  modified_base (347)..(347): a, c, t, g, unknown or other
  modified_base (357)..(357): a, c, t, g, unknown or other
  modified_base (360)..(360): a, c, t, g, unknown or other
  modified_base (374)..(374): a, c, t, g, unknown or other
  modified_base (443)..(443): a, c, t, g, unknown or other
  modified_base (448)..(448): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggaggagtcgtgggggaggcgtggtccagccgtgggaggtccctgagactctcctgtacngcctctggcttcaccttcattaccctatggcatgcacgtgggtcccnccagacctccgaggcgagggggctgggagtggggngctagttatnatntgattaggaatgtntacttctatcagtctccggtagacggcctattccgaccgtctaccgagacgaactactccgaggccacnccgtntggttactcctagacctaaagtcgaaacgcgaccgtagaggcgcgtagggacgacgacggtcgttaggttattagttaacgtgacgtaacggtaaattctttacgtaagttaaggg

SEQ ID NO: 410359 - DNA, 599 bp, Homo sapiens
  misc_feature: GZ8MTXP02H82XK.11.71.G05.1.454.CMB.2.raw
  modified_base (254)..(254): a, c, t, g, unknown or other
  modified_base (266)..(266): a, c, t, g, unknown or other
  modified_base (294)..(294): a, c, t, g, unknown or other
  modified_base (328)..(328): a, c, t, g, unknown or other
  modified_base (414)..(414): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagccgtggggacgtccctgagactctctgtacagcctnggcttcaccttnattaccatcggcatgcacgtgggtcccncagacctccgaggcgagggggctgggaggtgggngctagttattcatatagacgtaggaaattgtacgtactttctattcgacgtactccggtagaacggggtcctattcccaccgttcnccagacgacaacttccgaggtacacgaccgtctagtactcgtagaactaaatacgaacgacgaccgtagagagacgtaggacgacgtacggtcttaggttattaacgttacgtaggtacgaacgtaaaacgtatttaacgtaagtacggtaggtacggtaccgggtaacgggggttcctttacgg

SEQ ID NO: 410360 - DNA, 556 bp, Homo sapiens
  misc_feature: GZ8MTXP02JUI8K.11.71.G05.1.454.CMB.2.raw
  modified_base (280)..(280): a, c, t, g, unknown or other
  modified_base (309)..(309): a, c, t, g, unknown or other
  modified_base (318)..(318): a, c, t, g, unknown or other
  modified_base (350)..(350): a, c, t, g, unknown or other
  modified_base (359)..(359): a, c, t, g, unknown or other
  modified_base (372)..(372): a, c, t, g, unknown or other
  modified_base (378)..(378): a, c, t, g, unknown or other
  modified_base (414)..(414): a, c, t, g, unknown or other
  modified_base (450)..(450): a, c, t, g, unknown or other
  modified_base (456)..(456): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcgttgggttttcctcgttgcttacttttaagaggtgtccagtgtcaggtgcaacgtggaggagtcgtgggggagcgtggtccagccgtgggacgtccctgagactctcctgtacacgcctctggcttcaccttnacttaccatcgcatgccacgtcgggtccnccagtaccncgaggcgaggggctgggagtgggtgctagttnttcatacgngataggaaactgntacttntatcagcgtcgtaggaacgccgtaatccacgtcacngaacgtacactccagacacacgtactgtatctgaanaacaanaacgacgacgagagacgacgagagacgacgtcgtacgtagtacgtacgtacgtagtacgtaaagtaacgttactagtaggtacggtacgtacggtacggg

SEQ ID NO: 410361 - DNA, 519 bp, Homo sapiens
  misc_feature: GZ8MTXP02FGHUH.11.71.G05.1.454.CMB.2.raw
  modified_base (258)..(258): a, c, t, g, unknown or other
  modified_base (297)..(297): a, c, t, g, unknown or other
  modified_base (327)..(327): a, c, t, g, unknown or other
  modified_base (491)..(491): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggagagtctgggggagcgtggtccagcctgggagtccctgagactctcctgtacagcctntggcttcaccttcattacctatggcatgcactgggtccncagactccaggcagggggctggagtggggnggcagttatttcatatgatggaaatgtgacttctattcagactccgtgaaacggggccattcaccgtctccagagacaattccagcacacgctgtatctgacaaatgaaacagcctgagagcgtgaggacacggctgtagttaacttacgtgtgacgtaaaagntttacataggaggtacgacgtacggggg

SEQ ID NO: 410362 - DNA, 589 bp, Homo sapiens
  misc_feature: GZ8MTXP02FJ7DC.11.71.G05.1.454.CMB.2.raw
  modified_base (248)..(248): a, c, t, g, unknown or other
  modified_base (253)..(253): a, c, t, g, unknown or other
  modified_base (265)..(265): a, c, t, g, unknown or other
  modified_base (292)..(292): a, c, t, g, unknown or other
  modified_base (358)..(358): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggaggcgtggtccagccgtgggaggtcctgagactctcctgtacngcctntgcttcaccttnattacctatggcatgcacgtgggtccncagactccgaggcgagggggctggagtggggtgctagtttattcatatgatggaaatgtgtacttntatcagctcgtagaagggccattccacgtctaccagagacaacttccaggcacacgctgtatctgacaaatagaaacagaccctagacggtacgccgtaggaacggaacgacgggtacttaggttagttaaacgtttacgtacggtacggtaaccgtaaaaggttaactttaacgttaaagtaacgggtaggggttacggtaaaccgggttacggggggtaccgtttacgg

SEQ ID NO: 410363 - DNA, 561 bp, Homo sapiens
  misc_feature: GZ8MTXP02IFY89.11.71.G05.1.454.CMB.2.raw
  modified_base (269)..(269): a, c, t, g, unknown or other
  modified_base (314)..(314): a, c, t, g, unknown or other
  modified_base (381)..(381): a, c, t, g, unknown or other
  modified_base (451)..(451): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggagcgtggtccagccgtgggagtccctgagcctctcctgtacagcctntcggcttcaccttcacttacctatcggcatgccacgtcgggtccnccagacctccgaggcggaggggctgggaggtgggtgctagttattcatagtagtagtaggaattgtntactttactattcgagtaccgtcgtaggacggtcgtacttcgaccgtctaccagacgactatcgagcacncgtctgtactcagaacaatacgaacacgcctagagtcggacgtaggacgacgacggtcgttaggttatacgttaagaggtagtaacgtaaagtttctttacgtaagtagg

SEQ ID NO: 410364 - DNA, 534 bp, Homo sapiens
  misc_feature: GZ8MTXP02FVLB5.11.71.G05.1.454.CMB.2.raw
  modified_base (269)..(269): a, c, t, g, unknown or other
  modified_base (374)..(374): a, c, t, g, unknown or other
  modified_base (499)..(499): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaaactggaggagtcgtgggggagcgtggtccagcctggggagtccctgagactctcctgtacagcctcnggcttcaccttcattacctatggcatgcacgtggggtcccgcagacctccaaggcgagggggctgggagtggggtgctagtttatttcatatgatgggaatggtnaactttctattcagactccgtagaaacggccgattcacccgttcaccagacgacaaacttccaggccaacacgctagtatctgacaaaatcgaaacagcctgacgagctggaggacacggctgtnttataacgtgtacgacgtaaagtattcgtataagg

SEQ ID NO: 410365 - DNA, 618 bp, Homo sapiens
  misc_feature: GZ8MTXP02JZLDV.11.71.G05.1.454.CMB.2.raw
  modified_base (315)..(315): a, c, t, g, unknown or other
  modified_base (390)..(390): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcaacgtggaggagtcgtgggggagcgtggtccagccgtgggacggtccctgagactctcctgtacagcctctggccttcaccttcacttacctatggcatgcacgtcgggtcccnccagacctccgaggccgagggggctgggagtggggtggctaggtttatttcatatgataggtaatgtgtactttntattcgacgtactccgtaggaagggccgtacgttcctaccgtctaccagacgactactaccgaggtacacacgctgtatctgacaaactacgaacacgaccgtagaagacggtacgtacggacggaaccggtacgggtaccccccgtaggttacgttaacgtttaaccgttaggttacggtaacggtaaaaggttaacgttttaacggtttaacgtttaaaacggggg

SEQ ID NO: 410366 - DNA, 620 bp, Homo sapiens
  misc_feature: GZ8MTXP02GTGW1.11.71.G05.1.454.CMB.2.raw
  modified_base (185)..(185): a, c, t, g, unknown or other
  modified_base (259)..(259): a, c, t, g, unknown or other
  modified_base (264)..(264): a, c, t, g, unknown or other
  modified_base (270)..(270): a, c, t, g, unknown or other
  modified_base (279)..(279): a, c, t, g, unknown or other
  modified_base (286)..(286): a, c, t, g, unknown or other
  modified_base (295)..(295): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcgtggttttcctcgttgctcttttaagaggtntccagtgtcaggtgcaactggaggagtcgtgggggagcgtggtccagccgtgggagtcctgagctctcctgacncgctngtctcnctcatactngcatgcncgtcggccncagacctcgaggcggaggggctgggaggtggggtgtactagtttattcagtagtagtaagtaggtaatcgtacgtactttactaatacgacgtaccgtcggtaggaaacggtccgtaacgtccgtaccgtacctaccgaagaacgacctaacgtaccgacgaccaacgtacgtcgtagtactcgtacgaactaaagtacgaaacgcgtaccgtaggacgacggtacgtacgggaaccggtacgtaccggtacgttacggttagttaacgttaacgttaggtaacggtaaacggttaaaagttacgtttaacgtaaaggtaacggg

SEQ ID NO: 410367 - DNA, 527 bp, Homo sapiens
  misc_feature: GZ8MTXP02F2FCR.11.71.G05.1.454.CMB.2.raw
  modified_base (247)..(247): a, c, t, g, unknown or other
  modified_base (265)..(265): a, c, t, g, unknown or other
  modified_base (293)..(293): a, c, t, g, unknown or other
  modified_base (466)..(466): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctagggttttcctcgttgctcttttaagaggtgtccagtgtcaggtgcaactggaggagtcgtgggggaggcgtggtccagcctgggaggtccctgagactctcctgtacngcctctggcttcaccttnattacctatggcatgcacgtgggtcccncagactccaggcaggggctggagtgggtgctagttattcatatgataggaaatgtgacttcattcagactcgtgaagggcctattccacgtctccagaagacaattccaggacacacgctgtatacgtgacaaatacgaacagaccctagagagctgagacgacggctaggtntacgttactagtacgacggtaaatattaactaatacgacggtgacgtacgggggtcttacg

SEQ ID NO: 410368 - DNA, 614 bp, Homo sapiens
  misc_feature: GZ8MTXP02HLFBI.11.71.G05.1.454.CMB.2.raw
  modified_base (292)..(292): a, c, t, g, unknown or other
  modified_base (299)..(299): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccagccgtgggacggtccctgagactctcctgtacagcctctgcttcaccttcattaccatggcatgcacgtgggtccnccagccnccgaggcgagggggctgggaggtggggtgctaggtttacttcatagtgagtaggaaatgtgactttctatcgaagtctacgtaggaacggtctacttccaccgtctccaagacgactaacttacccgagccacacgcttacgtattcgtagaactaaagtacgaaaccacgtccgtaggaacgtaggacgaggaaacgggactaaccggtcgttaggttacgttatttaacgtggtaacgtaacgtaaagttacgtttaagtaagttaaggggtacggttacggtaaccgggttacgggggtttacgttttacgg

SEQ ID NO: 410369 - DNA, 599 bp, Homo sapiens
  misc_feature: GZ8MTXP02F9N52.11.71.G05.1.454.CMB.2.raw
  modified_base (294)..(294): a, c, t, g, unknown or other
  modified_base (340)..(340): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggacggtccctgagactctctgtacacgcctcgtggcttcaccttcattacctatggcatgcacgtcgggtccncagactcgaggcgaggggctgggagtgggtgctagtttattcatangaagtagaatgtcgtacttcgtatcgacgtacgtccggagaacgggctatccaccgtctacgagacgaactaacgtccgacggactacgacgtacttacgtactcctagaactaaagtacgaaaccgagaccctaggacgtacgtacgacggaacggaaccgacggtcttaggttagttaacgttacggtaggtacgtaacgtaaagttacttaacgtagtaacggtaggtacggacgggttacggggtctttaaccgg

SEQ ID NO: 410370 - DNA, 642 bp, Homo sapiens
  misc_feature: GZ8MTXP02H7697.11.71.G05.1.454.CMB.2.raw
  modified_base (245)..(245): a, c, t, g, unknown or other
  modified_base (256)..(256): a, c, t, g, unknown or other
  modified_base (259)..(259): a, c, t, g, unknown or other
  modified_base (263)..(264): a, c, t, g, unknown or other
  modified_base (267)..(268): a, c, t, g, unknown or other
  modified_base (270)..(270): a, c, t, g, unknown or other
  modified_base (272)..(272): a, c, t, g, unknown or other
  modified_base (281)..(281): a, c, t, g, unknown or other
  modified_base (287)..(287): a, c, t, g, unknown or other
  modified_base (306)..(306): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggtttcgcgtaggctctttaagaggtgtccagtgtcaggtgcaacgtggaggagtcgtgggggaggcgtggtccgagccgtgggagtcctgacgactctctgtacncgctgtgctcnctnatcnngcnncncncgtcggccncagccncgaggcggaggggcgtggnggtcggtcgtagttagttatacgagtagtagaagtaggtaaacttgtacgttactttacttagtcgaacgttaccgtaccggtaggtaccgggtcctacgttacccgacccgtctacgaagaactacgtaacgtaccgacgaccgaccgtacgtcgttacgtacgtacgtacgtaacgtaaacgtaacgtaacgtacgtacgtacgacgtacgtacgtacggtaacggacgtacggtacgttagttacgttacgttacgttacgtacgtaacgtaaacgttaacgttaagttacgtaacggtacggtacggtacgggttacgggttacggtttacg

SEQ ID NO: 410371 - DNA, 579 bp, Homo sapiens
  misc_feature: GZ8MTXP02IL92S.11.71.G05.1.454.CMB.2.raw
  modified_base (249)..(249): a, c, t, g, unknown or other
  modified_base (267)..(267): a, c, t, g, unknown or other
  modified_base (295)..(295): a, c, t, g, unknown or other
  modified_base (365)..(365): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggacgtccctgacgactctcctgtacngcctcgtgcttcaccttnattacctatggcatgcacgtcggtcccncagacctcgaggcgaggggctggagtggggtgctagtttattcatagtagtagtagaaatgtagtacttntattcagtactccggagaaggccattccacgtcacagacgataactcgaggtacaaccgacgtctagtactactgaactaaagtacgaaacgtacgacctagagacgctaggaacgacacggtacttgttagtaactttaaccggtggtacgaacgtaaagttactttaagtaagtacggtagggtacgtacgggttacggggtacgtttacgg

SEQ ID NO: 410372 - DNA, 652 bp, Homo sapiens
  misc_feature: GZ8MTXP02GFRWI.11.71.G05.1.454.CMB.2.raw
  modified_base (247)..(247): a, c, t, g, unknown or other
  modified_base (292)..(292): a, c, t, g, unknown or other
  modified_base (407)..(407): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtggggaggtccctgagactctctgtacngcctctgcttcaccttcattacctatggcatgcacgtcgggtccnccagacctccgaggcgaggggctgggaggtggggtgctagtttattcatatgataggaaatgtgtacttctattcgagtactccggagacgggcctattccaccgtctaccaganacatcgagacactacgctgtactctagaacctaaagtacgaaaccgtacgtacccgttaggaacggacggtacgtaacgggaacggggtaaccgaaccggggttcgttagggtttaagttaacgttttaacggtggttaacgggttaaaaccgtaaaggtttacctttaacggttaaacggttaaagggggtaacggggttaccgggtaaacggggtttaccggggggttacgtttttaaccggg

SEQ ID NO: 410373 - DNA, 702 bp, Homo sapiens
  misc_feature: GZ8MTXP02G0FWI.11.71.G05.1.454.CMB.2.raw
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcggtggtccagcctgggaggtccctgagactctcctgtacagcctctggcttcaccttcattacctatggcatgcactgggtccncagactccaggcgaggggctggagtgggtgcgtagttattcatgtgataggaaatgtagactttcgtatttccgagtaccttcccggtaggaaacgggggtccctaaacgtttcccgacccggttaccttacccccgaagtaacggaacctaaacgtttaccccgaacggggacccaacccgtaaaccggcccttaggttaacttacccgttaggaaccctaaaagttacgaaaacctaacggaccccttaggacggaaggtaccgttagggaacgggaccgaaaccggggtccgttaggttacgttaacgtttaaaccgtggttacggtaaccgtaaaagttacgtttaaccgttaagttaaacggagggttacggtaaccggtttacggggggtacctttttaccgggg

SEQ ID NO: 410374 - DNA, 594 bp, Homo sapiens
  misc_feature: GZ8MTXP02IZCO5.11.71.G05.1.454.CMB.2.raw
  modified_base (267)..(267): a, c, t, g, unknown or other
  modified_base (315)..(315): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcaacgtggaggagtcgtgggggaggcgtggtccaggcctggggacgtccctgagactctcctgtacngcctctggcttccaccttcattaccctatggcatgcacgtcgggtccnccagctccgaggcgagggggctgggagtggggtgctagttattcatagtgagtaggaactgtgacttgtattcagtcctccgtaggaacggtccgtattccgacccgtctacccgaagacgaactaactccgaggtccaacgacgcttagtactaccgtagaccaaaagtacgaaaccgagccctaggaacgacgacgtaggacggaacgtacggggcttacggtattaacgttaacgaggttacgaacgaaagtttacgtttactaaggttaaagggg

SEQ ID NO: 410375 - DNA, 621 bp, Homo sapiens
  misc_feature: GZ8MTXP02FOKUK.11.71.G05.1.454.CMB.2.raw
  modified_base (251)..(251): a, c, t, g, unknown or other
  modified_base (256)..(256): a, c, t, g, unknown or other
  modified_base (298)..(298): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggaggaggtcgtgggggagcggtggtccagccgtggggacggtccctgagactctcctgtacngcctntgcttcaccttcattaccctatggcatgcacgtcggggtccnccagacctcgaggcgaggggctgggacggtggggtgctaaggtttattcaatagtgataggaatgtgtacttctattcagtactccggtagagggtctattccaccgtctaccagacactaatcgagtcacgacgtctagtactacgagacctaaagtcgaaaacacgtacccgtaggaacgacggtaccgtaggaaacggacccgtacgggtcttacggttagttaacggtttaccttggtacgtaaacggtaaacgtttagtttaacgtaaagtagggtaacggtacggttaaccgggtaccgggggtacttttaaccggg

SEQ ID NO: 410376 - DNA, 612 bp, Homo sapiens
  misc_feature: GZ8MTXP02GVAVY.11.71.G05.1.454.CMB.2.raw
  modified_base (247)..(247): a, c, t, g, unknown or other
  modified_base (252)..(252): a, c, t, g, unknown or other
  modified_base (294)..(294): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagccgtgggagtccctgagactctcctgacngcctntcggcttcaccttcattaccatgcatcgctacgtgggtcccncagcctccgaggcgaggggctgggaggtgggtgctagttactttcatagtgagtaggaaattgtagtacttctattcgagtaccgttccggtagaacgggtcctaattccctaccgtctaccgagacgactaacgttaccacggtccaacgtacgtctagtactctagactaaatcgaaacacgacctagaagacgcgtaggacgggaacgacggtacgttagttacgttaacgttagtacggtagtaaacgttaaagttacttaacgttagtaacggtaggttacggtaacgggttaccgggggtacttttaaccgg

SEQ ID NO: 410377 - DNA, 665 bp, Homo sapiens
  misc_feature: GZ8MTXP02G6RHM.11.71.G05.1.454.CMB.2.raw
  modified_base (249)..(249): a, c, t, g, unknown or other
  modified_base (291)..(291): a, c, t, g, unknown or other
  modified_base (329)..(329): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacagcctntggcttcaccttcattacctatggcatcgctacgtgggtccnccagacctccgaggcgagggggtctgggaggttggggnggctaggtttattcgatagtgataggaaaatgtgtactttctaattcgaagtactccggtagaaacggggccctaattcccgaaccgtctacccgagtaacgaactaacttccgacggactaaccgacgtccttagttacttcgtacgtaacctaaaagtacgtaaaccgaacgtccgtaaggaacgtaacggccgtagggaaacggaacgaccgggtacgttacggttagttaacgtttaacggtggttacgaaaccggttaaaagttacgtttaacgtaaggttaacgggtaacgggtacggtaaccgggttaccggggggtacttttaaccgg

SEQ ID NO: 410378 - DNA, 636 bp, Homo sapiens
  misc_feature: GZ8MTXP02FK61I.11.71.G05.1.454.CMB.2.raw
  modified_base (249)..(249): a, c, t, g, unknown or other
  modified_base (269)..(269): a, c, t, g, unknown or other
  modified_base (299)..(299): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggtttttcctcgttgcttcttttaagaggtgtccagtgtcaggtgcaactggaggagtcgtgggggaggcgtggtccagcctggggaggtccctgagactctcctgtacngcctctggcttctacccttnattaccctatggcatgcacgtcgggtcccnccagacctccgaggcgagggggctgggacggtggggtggctaggtttatttcatagtgataggaaatagtgtacttctattccagtactccggtagaacggccgtattccgaccgtctacccagaacgtacaacgttacccacggaccaacgtaccgacttagttactactacgacaaaagttgaaacctaacggacccgtaggacggtagacgtaggaacggaccgaaccgggtcgtggttacggttatttaaccggttggtacgtacgtaaaacggttatttaacgttaagtacggtagggttacggtaaccggggtacgggggtacgtttacgg

SEQ ID NO: 410379 - DNA, 663 bp, Homo sapiens
  misc_feature: GZ8MTXP02IGZY3.11.71.G05.1.454.CMB.2.raw
  modified_base (260)..(260): a, c, t, g, unknown or other
  modified_base (305)..(305): a, c, t, g, unknown or other
  modified_base (357)..(357): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctgttgctcttttaagaggtgtccagtgtcaggtgcaatggaggagtcgtgggggaggcgtggtccagccgtgggagtccctgagctctcctgtacngcctgtgcttcaccttcattacctatggcagtgcacgtcggtccnccagctccgaggcggaggggctgggagtgggtggctagtttattcaattagnggtaatacgggtaaattgagttacttacgttattcgagtaccgtacggtaggaacgggccgtacgttacccgtacccgttccgaccgaacggtacgtaacctaaaccgtttaccgaacgggacccaaccgtaccggtcttacggttacgtacctacggtaacctaaaacgttacgtaaaccgaccggtaccgtaggaggtaacgacgttacggaacgggtaaaccggtcgggtacgttaggttacgtttaacgttaaccgttaggttacggaaacggttaatttacgtttacgtaaggttaacggg

SEQ ID NO: 410380 - DNA, 585 bp, Homo sapiens
  misc_feature: GZ8MTXP02FI0CO.11.71.G05.1.454.CMB.2.raw
  modified_base (295)..(295): a, c, t, g, unknown or other
  modified_base (331)..(331): a, c, t, g, unknown or other
  modified_base (362)..(362): a, c, t, g, unknown or other
  modified_base (380)..(380): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggaggagtcgtgggggaggcgtggtccagcctggggacggtccctgagactctcctgtacagcctctggcttcaccttcattacctatggcatgcacgtcgggtccncagacctccgagggcgagggggctgggaggtggggnggctagtttatttcatatgataggaaatgtnacttctattcagactcgngaacggcattcacgtctccagacgacaatcgagcacacgtctgtatctgacaaatagaaaccgagaccgtagagtacgacgtaggaacggacgacgggtacgtaggttagttaacgtttaacgtggtacgtaacgtaaaaggttaatttaacgtaagttaacggtacggggtacggtaacgggtaaccgggggtcgtttaaccgg

SEQ ID NO: 410381 - DNA, 590 bp, Homo sapiens
  misc_feature: GZ8MTXP02JK2O4.11.71.G05.1.454.CMB.2.raw
  modified_base (252)..(252): a, c, t, g, unknown or other
  modified_base (257)..(257): a, c, t, g, unknown or other
  modified_base (295)..(295): a, c, t, g, unknown or other
  modified_base (362)..(362): a, c, t, g, unknown or other
  modified_base (368)..(368): a, c, t, g, unknown or other
  modified_base (430)..(430): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggaggcgtggtccagccgtggggacggtccctgagactctcctgtacngcctntggcttcaccttcattacctatgcatgcacgtgggccnccagacctcgaggcgaggggctgggaggtggggtgctagtttattcattagtgaagtagaaattgtntacttntattcgagtctccggtagacgggtctatccaccgtctaccagacgactataccgagaccacncgtctagtactctagactaaagtcgaacgagaccgtagacgagcgtaggacggacgacggtacgttagttagttacttacgtaggtacgtaaacgtaaacgttagttaacgtaagttagggtacggtacggtaaccgggttacgggggttactttaccgg

SEQ ID NO: 410382 - DNA, 578 bp, Homo sapiens
  misc_feature: GZ8MTXP02GFHVV.11.71.G05.1.454.CMB.2.raw
  modified_base (248)..(248): a, c, t, g, unknown or other
  modified_base (297)..(297): a, c, t, g, unknown or other
  modified_base (362)..(362): a, c, t, g, unknown or other
  modified_base (368)..(368): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaaggaggtgtccagtgtcaggtgcaactggaggagtcgtgggggagcgtggtccagcctggggagtccctgagactctcctgtacngcctctgtcttccaccttcattacctatggcatgccacgtcgggtcccnccagacctccgaggcgagggggctgggaggtgggtggctagtttattcatatgataggaaatgtntacttntaattcgacgtctccggtgaacgggcctattcccacccgtctaccagacgaactaacgttccgacggacaccacgtcttgtactcgtacgactaaagtacgaactacgactaggacgagtcgtaggacgtacgacggtctaggtacgttattacgtgtacgacgtaaagtcttaagtaagaggtacggtgtacggtacggggtctttacg

SEQ ID NO: 410383 - DNA, 573 bp, Homo sapiens
  misc_feature: GZ8MTXP02FVGU8.11.71.G05.1.454.CMB.2.raw
  modified_base (293)..(293): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggagtccctgagactctcctgtacagcctctggcttcaccttcattacctatcggcatgcacgtcgggtcccnccacgacccccgagggccgagggggctggaggtggggtggctagttattcatatgatggaaaatgtgactttgtattcagtactccggtaggaacgggcctaattccgaccgtctaccgagacgacaattccgaggacacacgcctagtactatagacgtaaatagaacgagcgtacgaggacgccgaaggaccgacggaccgttattactttcgagtcgagaaacgacgtacgggacataacgtacgtacgtaccgtacgaccggtagggtactttaag

SEQ ID NO: 410384 - DNA, 739 bp, Homo sapiens
  misc_feature: GZ8MTXP02FOJOA.11.71.G05.1.454.CMB.2.raw
  modified_base (296)..(296): a, c, t, g, unknown or other
  modified_base (325)..(325): a, c, t, g, unknown or other
  modified_base (347)..(347): a, c, t, g, unknown or other
  modified_base (365)..(365): a, c, t, g, unknown or other
tcagcgagagataccacgaccggtgctcgatttagtgtcgtcgcaagagagaggagcccacgcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctggggagtccctgagactctcctgtacagcctctggcttcaccttcattacctatggcatgccacgtcggggtcccnccacgacctccgaggcgagggggctgggnggtggggtgactaggttatttnatatgagtaggaatagtntacttctattcgagtaccgtaccgtaggaaacgggtccgtacttacccgacccgttcctaacccgaacggaacgaaaccgttaaacgtttacccgaacgggtaccgaaacccgtaaccgtaccgttaaggttacgttacgtaacggtaaccaaaagttacgaaaacggaaccgtacccgtaagggaacgacggttacgacgggaaaccggacggtaaacccggttcggttaacggttaggtttaaacgtttaccgttagggtaacggaaaccggttaaaaggtttaacctttaacggttaaacgttaaacggggttaacgggttaacgggttaaccgggggttaaccggggggtttaccgttttaaacccgggg

SEQ ID NO: 410385 - DNA, 642 bp, Homo sapiens
  misc_feature: GZ8MTXP02I1PMA.11.71.G05.1.454.CMB.2.raw
  modified_base (260)..(260): a, c, t, g, unknown or other
  modified_base (307)..(307): a, c, t, g, unknown or other
  modified_base (375)..(375): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggacgtccctgagactctcctgtacngcctctggcttcaccttcattacctatggcatcgcacgtcgggtccnccagctccgaggcgagggggctgggagtggggtgctagttattcatagtgagtagaaatgtgactttntatcagtactccgtaggaaacgggtcctaattccgaccgtctaccgagaacgtactaacgttccgaaggtccaacgtacggtacttacgtacttacgtacgaacctaaagtaccgaaacgtaccgaccgttaggaacgaggtaccgtaggaacggaaccggtacgggtacgttacggtaagtttacgttaccgttacggtagtaacggtaaagttacgtttaacgttaacggtaaggtaacgggttacggtaaccggtttacggggg

SEQ ID NO: 410386 - DNA, 715 bp, Homo sapiens
  misc_feature: GZ8MTXP02HJ4FY.11.71.G05.1.454.CMB.2.raw
  modified_base (661)..(661): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggggagtcgtggggagggcgtggtccgacgccgtgggaggtccgtcgagactctcctgtcacgcctctcgtcttcctacctctattacctatggcatgcacgtcgggtcccgccacgactcccgagggcgaggggcgtggaggtggggtggacttagttagttttcattagtaggattaagggaaaacgttagttggtaaacctttttctaacgtttacacggtacccgttccggtaggggaaacggggtccccgtaattcccgtaccccggtacccttcccgaaaggtaacgaaacccgtaaactttaccccgaacggacccaaccggtaaccgtccgttagtacttaccgtacggtaaacctaaaagttacgaaaccacggtacccgtaaggtagaacgtcgtaacgggaacggacgtaaccggtcgtttagggtatttacgtttaaaccgtgggtacaagtaaaacgttntttagtaaggtacggtagggttacgtacggtaccggggtcgttttacgttacgg

SEQ ID NO: 410387 - DNA, 600 bp, Homo sapiens
  misc_feature: GZ8MTXP02G2T8L.11.71.G05.1.454.CMB.2.raw
  modified_base (205)..(205): a, c, t, g, unknown or other
  modified_base (269)..(269): a, c, t, g, unknown or other
  modified_base (299)..(299): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggaggagtcgtgggggnggaacgtggtccagccgtgggacgtccctgagactctcctgtacagcctctggcttcacccttnacttacctatggcatcgcacgtcggtcccncgacgcctccgaggcggaggggctgggaggtgggtggctaggtttacttacatagtgacgtaggaaattaggtacgtactttactattcaacgtacgttccgtaggaacggtccgtattacccgtaccgtcctacgagacgaactacttacgacgcaccgtacgactacgtatctagacaaagtacgaacacgacgtaggacgtagcgtagacgacgcgtacgttagtacgttattcgagtacgtaacgaagttacttaagtagtaaggttcggtagtacgggtaccggggtctttaacgg

SEQ ID NO: 410388 - DNA, 613 bp, Homo sapiens
  misc_feature: GZ8MTXP02GPK7P.11.71.G05.1.454.CMB.2.raw
  modified_base (308)..(308): a, c, t, g, unknown or other
  modified_base (512)..(512): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggagtccctgagactctcctgtacagcctctggcttcaccttcattacctatggcatgcacgtgggtcccncagctccgaggcgagggggctgggagtggggtgctagttattcatatgatagggaattgtcgtactttcattcgagtaccgtccgtagaaacgggcctaagttccgaacccgttctacccgaagacgtaacctaaacgttcccgaagggtccaaccgtaccgtccgtagtacgttccgtacgaacctaaaagtacgaaaaccgngacccgtaggaagtacgacgtaggaacggaccgaccgggtcttacggttagttaattccgtagtacggtaaacgtaaagtcgtttacgtaagttaacgggg

SEQ ID NO: 410389 - DNA, 538 bp, Homo sapiens
  misc_feature: GZ8MTXP02IP4VC.11.71.G05.1.454.CMB.2.raw
  modified_base (292)..(292): a, c, t, g, unknown or other
  modified_base (300)..(300): a, c, t, g, unknown or other
  modified_base (313)..(314): a, c, t, g, unknown or other
  modified_base (324)..(324): a, c, t, g, unknown or other
  modified_base (332)..(332): a, c, t, g, unknown or other
  modified_base (336)..(336): a, c, t, g, unknown or other
  modified_base (407)..(407): a, c, t, g, unknown or other
  modified_base (420)..(420): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaaactgggaggagtcgtgggggaggcgtggtccagcctgggaggtccctgagactctcctgtacagcctctggcttcaccttcattacctatggcatgcactgggtccnccagaccncgaggcgaggggnnggagtggcgntagttatnatangatagaaatgctacttctatcagactcgagaacgcatcacgtcacagacacaactacacgacacacgactntatatagacaaanagaacacgacgtagagagacgtagacgacgacgacgtagtagtacttattacgtacgtaacgtaaaagtaagttaagtaacgtaagtaaggtaggtaacggtacggggtacggttacg

SEQ ID NO: 410390 - DNA, 615 bp, Homo sapiens
  misc_feature: GZ8MTXP02JTE5N.11.71.G05.1.454.CMB.2.raw
  modified_base (251)..(251): a, c, t, g, unknown or other
  modified_base (340)..(340): a, c, t, g, unknown or other
  modified_base (479)..(479): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgtttgcttcttttaagaggttgtccagtgtcaggtgcaactggaggagtcgtgggggagcgtggtccagccgtgggacgtccctgagtactctcctgtacngtcctcgtggtcttcaccttcacttacctagtcggacagtcgaccgtacgttcgggcccaccgagacctccgaagggccggaggggtcngggtagggtcggggtagcgttaagtttatttcaattagtggaatagggtaaatggtacgtacttgtatcgagtactccggagacggtcatccaccgtctacagagactacgtacgacgacacgtacgctacgtatctanacgtaacgacgaacgacgaccgtagacgtacgacggtagacggacgacggtacgtagtacgttacttagtacgtacgaacgtaaagttacgttaagtagtaaggtacggtacgtacgggtacggggtactttacgg

SEQ ID NO: 410391 - DNA, 586 bp, Homo sapiens
  misc_feature: GZ8MTXP02G4DMA.11.71.G05.1.454.CMB.2.raw
  modified_base (288)..(288): a, c, t, g, unknown or other
  modified_base (314)..(314): a, c, t, g, unknown or other
  modified_base (359)..(359): a, c, t, g, unknown or other
tcagcgagagataccacgaccggtgctcgatttagtgtcgtcgcaagagagaggagcccagcactataagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggaggtccctgagactctcctgtacagcctctggcttcaccttcattaccatggcatgcacgtggccnccagcctccgaggcgaggggctgggnggtgggtgactagtttattcatatgaataggaaatgtactacttntattcagtactcggtagacgggtcattcccaccgtctaccgagacgactaacgtccgacggaccaacgacgcttcgttaatcgtagaaccaaaatgaaaccgacgtaccgtagaacgagacgtaggaacgggtacacggtacgtgttagtagttacgtacggtacgacggtaaagttacttaacgtaagtacggtaggtacggtacggtaccgggggtactttacgg

SEQ ID NO: 410392 - DNA, 681 bp, Homo sapiens
  misc_feature: GZ8MTXP02INQ9A.11.71.G05.1.454.CMB.2.raw
  modified_base (245)..(245): a, c, t, g, unknown or other
  modified_base (250)..(250): a, c, t, g, unknown or other
  modified_base (292)..(292): a, c, t, g, unknown or other
  modified_base (598)..(598): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagcctgggacgtccctgagactctctgtacngcctntgcttcaccttcattacctatggcatcgcacgtcgggtcccnccagacctcgaggcgagggggctgggacggtggggtgctagtttacttcatagtgactaggaaatgtcgtacttctacttcgagtaccgttccgagggtaaaccggggtcctaaatttcccgtaaacccggttcttacccgaaaggtaacgtaacccgtaaaacgttcccgaacgggtaccaaccggtaacgtccgttaggttaactccgtaggtaacctaaagtaccgtaacgaaacgtccctagggagtacggtacgtaggggaacgtacgaacggggttccttaggttagttaactttaccgnggtacgtaaaccgtaaaggtttactttaacgtaaggttaaggacgggttacggtacgggttaaccgggggtcgttttaaccgg

SEQ ID NO: 410393 - DNA, 637 bp, Homo sapiens
  misc_feature: GZ8MTXP02GL29C.11.71.G05.1.454.CMB.2.raw
  modified_base (248)..(248): a, c, t, g, unknown or other
  modified_base (295)..(295): a, c, t, g, unknown or other
  modified_base (324)..(324): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggaggagtcgtgggggagcgtggtccagccgtgggacggtccctgagactctcctgtacngcctctggccttcaccttcattacctatggcatgcacgtcgggtccnccagacctccgaggccgagggggctgggnggtgggtggctagtttatttcatagtgagtagggaaaattggtgtactttctatttccgagtaccgttccggtaggaacgggggtccctaattcccgtaacccgttcctacccgagtaacgaaacgtaacttacccgacggacctaaccgaccgtccttagtaacttctagaaccgtaaatacgaaacacgtaccgtagaggacgcgtagggacgacgaccgggtcttggtacgttattacgtaggtacgtaacgtaaagttacttaagttaagtaggtacgggttaggtacgggttacggggtacgtttccg

SEQ ID NO: 410394 - DNA, 623 bp, Homo sapiens
  misc_feature: GZ8MTXP02FSYW6.11.71.G05.1.454.CMB.2.raw
  modified_base (248)..(248): a, c, t, g, unknown or other
  modified_base (373)..(373): a, c, t, g, unknown or other
  modified_base (392)..(392): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtggggggaggcgtggtccagccgtgggacgtccctgagactctcctgtacngcctctggtcttcaccttcattacctatggcatcgcacgtcgggtccccaccaggacctccgagggcgagggggctggggaggtgggtggctagtttattcatagtgataggaaatgtgtacttntattcgacgtacttccggngaacggggcctattccgacccgtctaccagaacgactaacttacccgagggaccaacgaccgtacgtagtactctagaactaaagtacgaaacgacgtaccgtaggaagacggtacgtagggaacgggacgtaacgggtcgttagttagttaacgtttacgttgggtacgtaacggtaaagttaattaacgtaagtaacggtagggtagtacggtacgggggtctttacgg

SEQ ID NO: 410395 - DNA, 584 bp, Homo sapiens
  misc_feature: GZ8MTXP02FLZDM.11.71.G05.1.454.CMB.2.raw
  modified_base (248)..(248): a, c, t, g, unknown or other
  modified_base (296)..(296): a, c, t, g, unknown or other
  modified_base (343)..(343): a, c, t, g, unknown or other
  modified_base (367)..(367): a, c, t, g, unknown or other
  modified_base (401)..(401): a, c, t, g, unknown or other
  modified_base (419)..(419): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccaggcctggggacggtccctgagactctcctgtacngcctctggcttcaccttcattacctagtggcatgccacgtgggtcccncagactccgaggcgagggggctgggaggtggggtgctagtttacttnatatgagtaggaaatgtgtacttntattcagactcgtagaacggctactccaccgtcncagacacactcacgcacncgctgtatctacgactaaagacgaacgacgtccgtagacgacgcgtaggaacgacgacggtacgtaggttacgttaacgttacgttaggtacggtaacggtaaagttacgtttaacgtaagttaagggtacggttacggtaacgggttacgggggtcgtttacgg

SEQ ID NO: 410396 - DNA, 611 bp, Homo sapiens
  misc_feature: GZ8MTXP02G2Y6D.11.71.G05.1.454.CMB.2.raw
  modified_base (248)..(248): a, c, t, g, unknown or other
  modified_base (295)..(295): a, c, t, g, unknown or other
  modified_base (462)..(462): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactgggaggagtcgtgggggaggcgtggtccagccgtgggagtccctgagctctcctgtacngcctctgccttcaccttcattacctatggcatcgcacgtcgggtccnccagacctccgagggcgagggggtctggggaggtggggtcggtctaggtttattcatagtgagtaggaaattgtcgtacttactatcgaagtactccggtagacgggcctattcccgaccgtcctacgagacgactaacgtcgacgacacgactctagtactcgtanaactaagtacgacacgcctaggacgtacgacgtacggaaggacgacggtcttaggttagttaacgttaggtacggtagtaaacgttaagtttacgtttaagaagttaggtacgggtacggtacgggtttaccgggggtacttttaccgg

SEQ ID NO: 410397 - DNA, 535 bp, Homo sapiens
  misc_feature: GZ8MTXP02IOF5R.11.71.G05.1.454.CMB.2.raw
  modified_base (354)..(354): a, c, t, g, unknown or other
  modified_base (412)..(412): a, c, t, g, unknown or other
  modified_base (420)..(420): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggccttcaccttcattacctatggcatgcacgtgggtcccgccagactccaggcgagggggctgggagtggggtggcagttattcatatgataggaatagtnacttctatcagacgtccgtgaaggggcctattcacctctcgacgagacaatccacganaccacgcngtactctgacaactagaacagcctagagagcgtagaggacgacggacgtgtgtacgttatagtcgacgtaatagttaactagtagtaggtaggtacggttacgggggacgtttcg

SEQ ID NO: 410398 - DNA, 732 bp, Homo sapiens
  misc_feature: GZ8MTXP02HEC0J.11.71.G05.1.454.CMB.2.raw
  modified_base (247)..(247): a, c, t, g, unknown or other
  modified_base (252)..(252): a, c, t, g, unknown or other
  modified_base (264)..(264): a, c, t, g, unknown or other
  modified_base (291)..(291): a, c, t, g, unknown or other
tcagcgagagataccacgaccggtgctcgatttagtgtcgtcgcaagagagaggagcccagcactagaagtcggcggtgtttccattcggtgatcagcactgaacacagagactcaccatggagtttgggctgagcttgggttttcctcgttgcttcttttaagaggtgtccagtgtcaggtgcaactggaggagtcgtgggggagcgtggtccagccgtgggacgtccctgagactctcctgtacngcctntgcttcaccttnattccatggctagtgcacgtcggtccnccagctccgagggcagggggctgggaggtgggtggctaggttacttcgatagtgagtaggaaattagtgtacttcattccgagtactccgtagaacggtccgtacttacccgaccgttctacccgaagtacgtaactaacgttacccgaacggaccaaaccgaccgtaccgttacggttacttacccgttacgaacccgtaaaattacggaaaccgtaacgtaccgttacgggaaacggacggtacggttaaacgggtaacggggaaccgtaaccccgggggttacgtttaacgggttaggtttaaactttttaacccgggagggttaccgggtaaaccgttaaaaggtttaaccgtttaacggttaaaggttaaaccggggttacggggttaaccgggtaacccgggggttaaaccggggggtttccgtttaacccgggg

SEQ ID NO: 410399 - DNA, 573 bp, Homo sapiens
  misc_feature: GZ8MTXP02JT2CJ.11.71.G05.1.454.CMB.2.raw
  modified_base (267)..(267): a, c, t, g, unknown or other
  modified_base (272)..(272): a, c, t, g, unknown or other
  modified_base (277)..(277): a, c, t, g, unknown or other
  modified_base (281)..(281): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctctttaagaggtgtccagtgtcaggtgcaactggaggagtcgtgggggaggcgtgggtccaggccgtggggaggtccctgagacctctcctgtacngcctngctcnctcntaccatgcatgcatggccgccagctcgaggcgaggggctgggagtggggtgctagttattcatatgagtaggaattgtagtactttctattcgaagtaccgtccgtaggaacgggccgtacttacccgtaccgtcctacctacgacgtaacgacgttaccgaggcctaacgcgtactcgtagtctagactaaacgtacgaacacgtacccgtgaacgtacgcgtaggacgggaccacggtcgtagttacgttagttaacgtgtacgtacgaagttactttacgtagttaagg

SEQ ID NO: 410400 - DNA, 641 bp, Homo sapiens
  misc_feature: GZ8MTXP02JF0IJ.11.71.G05.1.454.CMB.2.raw
  modified_base (249)..(249): a, c, t, g, unknown or other
  modified_base (290)..(290): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacagcctntggcttcaccttcattacctatggcatgccacgtgggtccnccagacctcgaggcgaggggctgggagtggggtgctagtttattcatagtgagtaggaaatgtagtactttctatttcgaagtcctaccggtaggaacgggtccgtatttaccgtacccgtcctacccgaaggaacgaacctaacgttacccgacggacctaacgacgtcgtagttactccgtaggacctaaagtacgtaaaccgacgcccgttaggaagtacggccgtaggacgggacgacgggtacgttaggttagttacttaacggtggttacggtaacgtaaaggttacttaacgttagtaaggtacgggttaggtaaccgggttacgggggttacgttttaaccgg

SEQ ID NO: 410401 - DNA, 614 bp, Homo sapiens
  misc_feature: GZ8MTXP02JS6QD.11.71.G05.1.454.CMB.2.raw
  modified_base (253)..(253): a, c, t, g, unknown or other
  modified_base (265)..(265): a, c, t, g, unknown or other
  modified_base (313)..(313): a, c, t, g, unknown or other
  modified_base (350)..(350): a, c, t, g, unknown or other
  modified_base (535)..(535): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggacgtccctganctctcctgtacngcctgtgcttcaccttcacttacctatggctatgctacgtcgggtccnccaagacctccgagggtcgaggggctgggagtggggngctagtttattcattagtgatacgggtaattgtactactttctaattcgaagtaccgtcgtaggaaacggtccgtacttccgaccgtctaccgaagaacgtaaccgtaacttaccgaacggaccaactaccggtcttacgtacttcgtacgaactaaatacgaaacacgtacctaggaagaccgngacggaacggaccgtacggtacgtacggttagttacgtaagtacggtacgaacgtaaagttactttaacgtagtaacgg

SEQ ID NO: 410402 - DNA, 618 bp, Homo sapiens
  misc_feature: GZ8MTXP02FKLQ3.11.71.G05.1.454.CMB.2.raw
  modified_base (256)..(256): a, c, t, g, unknown or other
  modified_base (297)..(297): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggaggagtcgtgggggaggcggtggtccaggcctggggacggtccctgagactctcctgtacagcctntggtcttcaccttcattacctatgcatgcacgtcgggtccnccagacctccgaggcgagggggctgggaggtgggtgctagtttatttacattagtagagtaggaaatgtgtacttcgtattcagtactcggtagaacgggtcctattcaccgtctaccagacgactaactccgagcacacgactgtaactctagaactaaacgtacgaaaccgacgtacccgtaggaccggtagacgtacggaacgggtaccgacggtcgttaggttagttaagtttacgttaggtacgtaaacgtaaagttactttaacgtaagttaaaggtacgggtacggtaacggggtaaccgggggtcgtttacgg

SEQ ID NO: 410403 - DNA, 701 bp, Homo sapiens
  misc_feature: GZ8MTXP02F2HFY.11.71.G05.1.454.CMB.2.raw
  modified_base (316)..(316): a, c, t, g, unknown or other
  modified_base (396)..(396): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagccgtgggagtccctgagctctcctgtacagcctctggcttcaccttcactttacctatcggcagtgcctacgtcggggtcccncctagacctccgagggccgagggggctgggaggtggggtggcagtttactttcgattagtgattaggaatgagtactttntaattcaaagtacccgttacccggtaagggacccggtacgtacttacccgtaccgttacccacgtaagtaaccgtaactaacccgtacggtaaccgaccgtaaaccgaccgttagttacctacgttaccgtactaaaccgtaaacgtacgaaaccgtccgtacgagggaacggtacgtacgggtaacgggtaccggaaacgggtaccggttacggttacggttaacgtttaacgttaaccggttaagggtaacggtaaaaccgggtttaaatttaccgtttaaacggttaacggttaaacggggg

SEQ ID NO: 410404 - DNA, 607 bp, Homo sapiens
  misc_feature: GZ8MTXP02GOVER.11.71.G05.1.454.CMB.2.raw
  modified_base (244)..(244): a, c, t, g, unknown or other
  modified_base (290)..(290): a, c, t, g, unknown or other
  modified_base (322)..(322): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggagtccctgagactctctgtacngcctcgtgcttcaccttcattacctatgcatgctacgtcgggtccncagcctccgaggcgaggggctgggaggtgggngctagtttattcatagtgataggaaattgtgtacttcgtatcgagtactccggtagacgggtcctattcccgaccgtctcccgaagtacgactaatccgaggtcacacgtctagtacttcgagaactaaagtacgaaacctagaccgtagaacgacgtacggtaggacggtaaccgacgggtacttaggttagttaacgttacgtacggtacgtaaccggtaaagttacgtttaacgtaaggtaggtacggggtacgtaaccggggtacgggggttactttacgg

SEQ ID NO: 410405 - DNA, 684 bp, Homo sapiens
  misc_feature: GZ8MTXP02IOXWH.11.71.G05.1.454.CMB.2.raw
  modified_base (273)..(273): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtgggaggagtcgtgggggaggcgtggtccaggccgtggggacggtccctggacgactcctcctgtacncgtcctcgtcgtccttcctaccttctacttacctagtggctagtcgcctcggttccgggccccaccgacgtaccgtccggacgggtccggggagggggtcgtaggggtagggtggggtcggtacttagtttacttcagttagtagtaacgtaggtaagttacgtctacctttagttactacgaacgttccgtacggtaggaaccggtcctacttcccgtacccgtctaccgaagacgtaactactaccgacgaccacgtacgtactagttactaccagaactaaagtacgaaacgtacgtacgtagaacgtacggacgtaggacggtaaccggaccggttacgtacggtttaacgttaacgtcggtaggtaacgtaaaacggttaaacgtttctttaacggtaagtacggg

SEQ ID NO: 410406 - DNA, 646 bp, Homo sapiens
  misc_feature: GZ8MTXP02I67CM.11.71.G05.1.454.CMB.2.raw
  modified_base (246)..(246): a, c, t, g, unknown or other
  modified_base (264)..(264): a, c, t, g, unknown or other
  modified_base (290)..(290): a, c, t, g, unknown or other
  modified_base (329)..(329): a, c, t, g, unknown or other
  modified_base (347)..(347): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccaggcctgggaggtccctgagactctcctgtacngcctctggcttcaccttnattaccatggcatgcacgtgggtccncagacctccgaggcgaggggctggagtgggtgctagttnttcatatgatgaaatgtnacttctattcagtactccgagaacgggccattccaccgtctaccgagacgactaacttcccgaggcctaacgaccgtacgtcgttaactccgttacgaccgtaaaagttacgaaaccgtaacggtacccgtaggaaggtaacggtccggttaagggaaaccggggtaaccgaacggggtccgttaggttacgttaacgtttaaaccgttcgggttacggtaaacggtaaaacgtttagtttaacgttaaagttaacgggtagggttacggtaaccgggtaacgggggttccgtttacgg

SEQ ID NO: 410407 - DNA, 547 bp, Homo sapiens
  misc_feature: GZ8MTXP02HZFXN.11.71.G05.1.454.CMB.2.raw
  modified_base (260)..(260): a, c, t, g, unknown or other
  modified_base (463)..(463): a, c, t, g, unknown or other
  modified_base (476)..(476): a, c, t, g, unknown or other
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggagcgtggtccagcctgggaggtccctgagctctcctgtacagcctntggcttcaccttcattacctatggcatgcactggtccgccagacctcgaggcgagggggctgggagtgggtgctagttattcatactagatggaaatgtgacttcgtattcaagaccttccggtaggaaacgggtccgaacttcgaacccgtctaccgagaagacaacttccgaagccacacgctgtatctgacaaatgaacngacctgacgagcngacggacgacggctgtagtactactagtagacgtaaaggtatttactagtagacggttagacgtacggggg

SEQ ID NO: 410408 - DNA, 541 bp, Homo sapiens
  misc_feature: GZ8MTXP02GI38H.11.71.G05.1.454.CMB.2.raw
  modified_base (275)..(275): a, c, t, g, unknown or other
  modified_base (367)..(367): a, c, t, g, unknown or other
  modified_base (416)..(416): a, c, t, g, unknown or other
  modified_base (430)..(430): a, c, t, g, unknown or other
  modified_base (432)..(432): a, c, t, g, unknown or other
  modified_base (438)..(438): a, c, t, g, unknown or other
  modified_base (440)..(440): a, c, t, g, unknown or other
  modified_base (443)..(443): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctcctgtacagcctctggccttcaccttnattacctatggcatgcacgtggtcccgcagacctccgaggccgagggggctgggagtgggtggctagttatttcatatgatggaaaattcgngtacttctattcagactcgtagaaagggccgtatcaccgtcaccagaanacatcagacacacntntatcananaanagaacacgacgagagagacgagagacgacgacgtgtagttacttacgtacgtagaacgtaaagtaattactagtaggtacggtacggtacggtacggg

SEQ ID NO: 410409 - DNA, 625 bp, Homo sapiens
  misc_feature: GZ8MTXP02JHY1H.11.71.G05.1.454.CMB.2.raw
  modified_base (250)..(250): a, c, t, g, unknown or other
  modified_base (255)..(255): a, c, t, g, unknown or other
  modified_base (267)..(267): a, c, t, g, unknown or other
  modified_base (296)..(296): a, c, t, g, unknown or other
  modified_base (336)..(336): a, c, t, g, unknown or other
  modified_base (345)..(345): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccaggccgtggggacgtccctgagactctcctgtacngcctntgcttcaccttnattacctatggcatcgcacgtcgggtccnccagcctccgaggcgaggggctgggagtgggtgctagttnttacatagngtaacgtaggtaaaattggtgtactttctatttccgaacgtacgttccgggtaagaacggggtccaattcccgacccgtctaccgagacgaactaacgttaccaacggctaaccgaccggacttacggttactacctaggaacctaaagtacgaaacccgtagcccgttaaggacgaggactagggaacgacgacggtactgttacgttatacgtagtacgaacgtaagttacttaacgtaagtaggtacggtcggtaaccggtacggggtactttacgg

SEQ ID NO: 410410 - DNA, 666 bp, Homo sapiens
  misc_feature: GZ8MTXP02FFQXF.11.71.G05.1.454.CMB.2.raw
  modified_base (181)..(181): a, c, t, g, unknown or other
  modified_base (199)..(199): a, c, t, g, unknown or other
  modified_base (309)..(309): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtncaactggaggagtcgtgggggagcgtggtccagcctggggagtccctgacgactctcctgtacagcctctggcttcaccttcattacctatggcatgcacgtgggtcccnccagacctccgaggcagggggctgggagtgggtgcagttattcatatgatgggaactgtgtaactttcgtaattcaacgtactcccgtaggaaacggggtcccgtaatttcccgacccgttcctacccgaagaacgacctaaaacgttcccgaagggacccaaaccgtaccggtccttaggttaacttccgttacggaacccaaaaagttcggaaaaccaacggccccgtaggaaacggtaacggcccgttagggaaacgggaaccgtaaccgggggtccttaggtacggtttaaactttaaccggtaggttaggaaccgggtaaaaagtttatttaaccgttaagttaaaacgggg

SEQ ID NO: 410411 - DNA, 548 bp, Homo sapiens
  misc_feature: GZ8MTXP02JH8R1.11.71.G05.1.454.CMB.2.raw
  modified_base (195)..(195): a, c, t, g, unknown or other
  modified_base (262)..(262): a, c, t, g, unknown or other
  modified_base (320)..(320): a, c, t, g, unknown or other
  modified_base (342)..(342): a, c, t, g, unknown or other
  modified_base (371)..(371): a, c, t, g, unknown or other
  modified_base (380)..(380): a, c, t, g, unknown or other
  modified_base (417)..(417): a, c, t, g, unknown or other
  modified_base (431)..(431): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
tcagcgagagataccacgaccggtgctcgatttagtgtcgtcgcaagagagaggggggggagaggagcccagcactagaagtcggcggtgtttccattcggtgatcggcactgaacacagaggactcaccatggagtttgggctgagcttgggttttcctcgttgcttcttttaagaggtgtccagtgtcaggtncaacgtggaggagtcgtgggggaggcgtggtccagccgtgggacgtccctggagcctctcctgtacngcctgtggcttcaccttcacttacctatggcagtcgcacgtggtcccgcacgctccgnggcgaggggctgggagtggggngctagttattcatatgataggaaatggtntacttcgtntcgagctccggagaacggcctatcaccgtctacaganacatcagcacacgntgtatcnganaanacgaacagcctagacgcgtacgaggagacgacggtcgtagttagttacttacgtgtacgacgtaaagtcttatagtaggtaggtacggtacggtacggggttcg

SEQ ID NO: 410412 - DNA, 625 bp, Homo sapiens
  misc_feature: GZ8MTXP02GPJKJ.11.71.G05.1.454.CMB.2.raw
  modified_base (245)..(245): a, c, t, g, unknown or other
  modified_base (250)..(250): a, c, t, g, unknown or other
  modified_base (255)..(255): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggaggcgtggtccagccgtgggagtccctgagctctctgtacngcctngctcnctcattacctatgcatgcacgtcggtccacagacctcgaggcgaggggctgggaggtgggtgcgtagttattcatgtagataggaaaatgtagtactttatattccgagtacctccggtagaacggggtcctattcccacccgtctaccgacgaacgaactaacttacccgacgtacaaccacgactagtactcgtagtacaaatacgaacgtacgaccgtagacgtagaccgtaggaacggacgtacggtacgttagttacgttaacgttacgtggttacggtaaacgttaaaaggttaacttttaacgtaaaggttaacgggtagggttaacgggtaaccggggttacgggggtaccgttttaaccgg

SEQ ID NO: 410413 - DNA, 660 bp, Homo sapiens
  misc_feature: GZ8MTXP02FVM99.11.71.G05.1.454.CMB.2.raw
  modified_base (245)..(245): a, c, t, g, unknown or other
  modified_base (299)..(299): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggagtccctgagactctcctgtacngcctctggtcttcaccttcattaccctatggcagtcgctacgtcggggtccccncacgacctccgaggcgaggggtctgggaggtggggtgctaggtttatttcgaattagtagaagtaggtaaactagtcgtactttctatttcgacgtaccgttacggtacggaaacgggttcctattcccaaccgttcgtacccgaagaacgaactaacgttccgacggaccaccgtacgtctagtactctagaacctaaatacggaaacacgtaccgaggacggacgcgtaggaacggtacgtaacgggtcgttaggttaggttaactttaccggaggttacgtaacgttaaagtttacgtttaacgttaacggtaagggttacggtacgggttaacgggtaccgggggttacgtttacgg

SEQ ID NO: 410414 - DNA, 673 bp, Homo sapiens
  misc_feature: GZ8MTXP02IUMWP.11.71.G05.1.454.CMB.2.raw
  modified_base (248)..(248): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggacgtccctgagactctcctgtacngcctcgtggtccttcaccttctacttaccctatcggctagtcgccacggtcgggtccccaccagaccctccggagggcggaggggggctggggaggtggggtcgtacgtagtttactttcattagtggtaagtaggtaaaattggtacgtactttacttattccgaagtactcccgggtagaacgggtcctattcccgacccgtctaccgagacgtaactaacgtaccgaggaccaacgacgtcttagtactcgtacgaactaaagtacgaacacgtaccgtagaagtacggtcgtacggaacgggacgtaacgggtcttacggttagttaacgttacgtacggtacggtaacgtaaaagtttactttaacgtaagtaagggtacgggttacggtaaccggggttacgggggttccgtttaacgg

SEQ ID NO: 410415 - DNA, 695 bp, Homo sapiens
  misc_feature: GZ8MTXP02JLKMJ.11.71.G05.1.454.CMB.2.raw
  modified_base (296)..(296): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccaggcctggggacggtccctgagactctcctgtacagcctctggccttcaccttcattacctatggcatgcacgtcgggtccnccagactccgaggcgagggggctgggaggtcgggtgctaggtttattcatatgagtagaaatagtctacttctattcagtcgtccggtagaacggggcctaacttccgaacccgttctaccgaacgacgaacaacgttccgaacggtacaacccgacggtactacggttaactacctaggtaaccctaaaagttacgaaaccgtaacgacccgttaggaacggtacggacgtacgggaacgggtaaccgaacccgggttcttaggggttacgttaacggtttaccgttaaggggtacggtaaccggttaaaaacgtttagttttaaccgtaaacggttaacggggtaagggttacgggtaaacccggggttaaccgggggtcggtttttaaaccccggg

SEQ ID NO: 410416 - DNA, 598 bp, Homo sapiens
  misc_feature: GZ8MTXP02GLW7S.11.71.G05.1.454.CMB.2.raw
  modified_base (250)..(250): a, c, t, g, unknown or other
  modified_base (263)..(263): a, c, t, g, unknown or other
  modified_base (292)..(292): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagcctgggagtccctgagactctcctgtacagcctntggcttcaccttnacttacctatggcatcgcacgtgggcccncagacctcgaggcggaggggctgggagtgggtgctagtttattcatagtcgaataggaaatggtctacttctattcgagtaccgtccgtaggacggtcgtactccacgtctacagacgactaactcgagcacgactctagtactctagaactaaagtacgaaaccgacgtacccgtaggagacgtacgtaggacggtacgacgtcgtaggttacgtacttaccgtaggtacgtaacgtaaaagttcgttaacgttaaggtaaggttacgggtacggtaaccgggttacgggggttacttttaccgg

SEQ ID NO: 410417 - DNA, 758 bp, Homo sapiens
  misc_feature: GZ8MTXP02G2EZN.11.71.G05.1.454.CMB.2.raw
  modified_base (272)..(272): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcgttggttttcctcgttgcttcttttaagaggttgtccagtgtcaggtgacaacgtgggaggagtcgtgggggaggcggtggtccaggccgtgggacgtccctgagactctcctgtacncgcctcgtggtccttcctaccttctacttacctagtcggctagtcgaccgtacggtcggggtccccaccgaaggtaccctccggaagggccgggtaacgggggggccttagggggaggttcgggggtcggtacgttaaggttttacttttacgaagttaacgtaggtaaagttagggtaaagttgggtacgttaacctttaccgttattaccgtaaacgtacccgttaccgggtaacgggtaaacgggtacccgtaacgtttacccgaacccgttaccgtacccgaagaaaccgtaacttaaaccgttcccgaacggtaccaacccgtacgtgtacgttacttaccgtacgaaacttaacctaagaacccgagaaccggtaggaagtcggaaccggtggaaaccgggacgacgggttaccgtacgtttaggtattaaccggtagtaacggtaaacgtaaagttacgtttacgtaaaggttacgggg

SEQ ID NO: 410418 - DNA, 601 bp, Homo sapiens
  misc_feature: GZ8MTXP02JK3ME.11.71.G05.1.454.CMB.2.raw
  modified_base (263)..(263): a, c, t, g, unknown or other
  modified_base (313)..(313): a, c, t, g, unknown or other
  modified_base (384)..(384): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggagagtcgtgggggagcgtggtccagccgtgggacgtcctgagactctcctgtacncgcctctggcttcaccttcacttacctatcggcatgctacgtcgggtccncagactccgaggcgaggggctgggagtgggtgctagttacttcattatgtagtaggaattgtatacctttntattacgacgtaccgtaccgtaggacggtaccgtactcgtacccgtcctaccgacgacgtactaactaccgtacgaccgaccgacgtacgtacgtactactacgacaaacgtacgaacgacgtaccgtagacgacgacgtaggacggacgacggtacgtacgttacgttagttaacgtagtacgtacgtaaacgtacgtttagtacccccgttaagg

SEQ ID NO: 410419 - DNA, 569 bp, Homo sapiens
  misc_feature: GZ8MTXP02GG7M3.11.71.G05.1.454.CMB.2.raw
  modified_base (268)..(268): a, c, t, g, unknown or other
  modified_base (298)..(298): a, c, t, g, unknown or other
  modified_base (316)..(316): a, c, t, g, unknown or other
  modified_base (350)..(350): a, c, t, g, unknown or other
  modified_base (362)..(362): a, c, t, g, unknown or other
  modified_base (486)..(486): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaaggaggtgtccagtgtcaggtgcaacgtgggaggagtcgtgggggagcgtggtccagccgtggggacgtccctgagctctcctgtacngcctctggtcttccaccttcaacttcctanggcatgcacgtgggcccnccagcctccgaggccgaggggctgggagtggggngctagtttcttnagtatgaagtaggtaatgtgtactttctagtcagaccgtcgtaggaacggctactcctaccgtctacagacgaactactccgaggcaacgtcgactagtactctacgactaaactcggaaaccncgcgtagagacgtgacggacgacgacggtcgtacgttagttacgttaagtgtacgtaacgtaatttacgttacgtaacgtagg

SEQ ID NO: 410420 - DNA, 660 bp, Homo sapiens
  misc_feature: GZ8MTXP02G3DJP.11.71.G05.1.454.CMB.2.raw
  modified_base (183)..(183): a, c, t, g, unknown or other
  modified_base (248)..(248): a, c, t, g, unknown or other
  modified_base (265)..(265): a, c, t, g, unknown or other
  modified_base (295)..(295): a, c, t, g, unknown or other
  modified_base (320)..(320): a, c, t, g, unknown or other
  modified_base (328)..(328): a, c, t, g, unknown or other
  modified_base (348)..(348): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtncaacgtggaggagtcgtgggggagcgtggtccagccgtgggacgtccctgacgactctctgtacngcctctgcttcaccttnattacctatggcatcgctacgtcgggtccnccagcctcgaggcgaggggctgggnggtggggngcttaggtttattcagtagngtagtagtaatagtcgtacttctattccgagtacgtccggagtaaccgggtctacttcccgaccgtctaccgaagacgaactaactaccgacgggacctaaccgacgtcttaggtaactcccgaagtacctaaaactacggaaaccgtacgacccgtagaacggtaaacggtccgtaagggaaacgggtaccgaccggttacgttaggttacgttaaacgttaccgtagggtaacgtaacgtaaaagtttcttaacggttaaacggaggtaacgggttcggtaacgggtttaccgggggacttttaaccggg

SEQ ID NO: 410421 - DNA, 774 bp, Homo sapiens
  misc_feature: GZ8MTXP02IS2PK.11.71.G05.1.454.CMB.2.raw
  modified_base (183)..(183): a, c, t, g, unknown or other
  modified_base (247)..(247): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtncaactggaggagtcgtgggggagcgtggtccagccgtgggacgtcctgagtactcctctgtacncgcctgtcgtcttcaccttctacttacctagtggctatcgctacggtcggcccacagacctccgagggcggacggggtctggggtaggtggggtgacttagtttactttcgattaagtgtaacggtaagggtaaaatttcggttagttaacccttttacttaacgtttcgtaacgttaaccccggtttccggggtaagggtaaacccgggggtccttaaacgtttaccccctaacccgggtttaccctaacccggtaaacgaaacgtaaacccgttaaaacccgtttacccggaaaccgggtacccaaaccggtaaccggttaccttacggtttaaccttacccggtaagtaaacccttaaaagtaccgaaaacgacccgtaccgttaaggaacggtaaccggaacgttacgggaaacggaacgtaccggtacgtttaggttaacgttagtaacgtcggtagaaccggtaatttagtttaacgtaagtaacggtaggtacgtaaccggggtcggggttactttacgg

SEQ ID NO: 410422 - DNA, 527 bp, Homo sapiens
  misc_feature: GZ8MTXP02FO2L7.11.71.G05.1.454.CMB.2.raw
  modified_base (309)..(309): a, c, t, g, unknown or other
  modified_base (377)..(377): a, c, t, g, unknown or other
  modified_base (389)..(389): a, c, t, g, unknown or other
  modified_base (404)..(404): a, c, t, g, unknown or other
  modified_base (421)..(421): a, c, t, g, unknown or other
  modified_base (432)..(432): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctggagactctcctgtacagcctctggcttcaccttcattacctatggcatgcacgtgggtccnccagacctccgaggcgagggggctgggagtggggtgctagttatttcatatgataggatgtgtacttntatcagactcgngacggcatcacgtcncagagacatcgagcacncgctgtactcngacaaatacgaacacgccgtagagacgtcgtacggacggtacgacggtctagtcgttattaacgtgtacgtacgaaagtactttacgagttaagg

SEQ ID NO: 410423 - DNA, 657 bp, Homo sapiens
  misc_feature: GZ8MTXP02FM686.11.71.G05.1.454.CMB.2.raw
  modified_base (250)..(250): a, c, t, g, unknown or other
  modified_base (255)..(255): a, c, t, g, unknown or other
  modified_base (295)..(295): a, c, t, g, unknown or other
  modified_base (340)..(340): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactgggaggagtcgtgggggagcggtggtccagccgtgggaggtccctgagactctcctgtacngcctntggcttcaccttcattacctatggcatgcacgtgggcccncagacctcgaggcgaggggctgggaggtgggtgctaggtttattnatagtgaataggaaactggtactactttctaattcgaagtaccgttccggtaggacgggtacccgtattcccgacccgtctaccgagacgtaactaacttaccgacggccaacgtaccgtacttacgtacttacgtacggtaactaaaacgtcgaaaaccgtacgtcccgtaagggaacggtacggtaccgtagggaaccgggtaacggaccggtacgttagggtacgtttaacgtttaccgtagggtacgtaaacggtaaagttactttaagtagtaacgggtaggtacggtacgggtaacggggtcgtttaacgg

SEQ ID NO: 410424 - DNA, 765 bp, Homo sapiens
  misc_feature: GZ8MTXP02GN3JG.11.71.G05.1.454.CMB.2.raw
  modified_base (246)..(246): a, c, t, g, unknown or other
  modified_base (294)..(294): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagccgtgggagtccctgagactctcctgtacngcctctgtcttcaccttctattacctatggcatcgcacgtcgggtccnccagacctccgaggcggagggggctggggtacggttggggtcggacttaggtttactttcgaattaggtagtaagttaaggggtaaaagttggttacgttaccttttacgttaatttaccgtaacggtaccgttccgggttaagggaaccggggtcccgttaacttccccgtaacccgttccgttacccgaaagtaacggtaaccctaaaccgttacccggacgggtacccaaccgtaacgtccgttacggttaacttaccgtaacgggtaaacttaaacgaccggaaaacctcggtacccgttaagggagacccggttagaacggggtaaacgggacccgtacggtacgtttacggtttaaggtttaacgttttacggaggtttaccggaaaacgttaaaggtttatttaacgtaagggtaacggtagggtacgggtaaccgggttacgggggtttccttttaaccgggg

SEQ ID NO: 410425 - DNA, 586 bp, Homo sapiens
  misc_feature: GZ8MTXP02H98GW.11.71.G05.1.454.CMB.2.raw
  modified_base (250)..(250): a, c, t, g, unknown or other
  modified_base (289)..(289): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgacgactctcctgtacagcctntggcttcaccttcattacctatggcatgcactgggtccnccagctccgaggcgagggggctggagtgggtcgctagtttattcatagtgagtaggaaatgtgtacttctattcagtacctccggtagaacgggcctattccaccgtcaccgagacgactaattccgagtcacacgctagtactccgtagactaaagtcgaaaccgtacgaccgtagagacgtacgtaggaacggaaccgacgggtaccgttaggttggttaaactttacgtaggtacgaacgtaaagttactttaacgtaagtaggtaggtaggacggttaacgggggtctttacg

SEQ ID NO: 410426 - DNA, 612 bp, Homo sapiens
  misc_feature: GZ8MTXP02F61J7.11.71.G05.1.454.CMB.2.raw
  modified_base (302)..(302): a, c, t, g, unknown or other
  modified_base (331)..(331): a, c, t, g, unknown or other
  modified_base (338)..(338): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggaggaggtcgtggggggaggcggtggtccaggccgtggggacggtccctgagactctcctgtacagcctctggcttcaccttcattacctatggcatcgctacgtgggtcccnccagacctccgagggcgagggggctgggnggtgggngctagtttattcatagtgatagaaatgtagtacttctatcacgtactcggtagaacggggcctaacttccgaccgtctaccgaagacgaactaacttaccgacggccaacgacgactagtatccgtagactaaagtacgaaccgtagacccgtagacggtacgtacgtagggaacgacgaacggtcgtaggttacgttacgttacgtacggtacgaacgtaagttaacttaagtaagtaaggtacggtagtaccgggtacgggggtctttacgg

SEQ ID NO: 410427 - DNA, 626 bp, Homo sapiens
  misc_feature: GZ8MTXP02F5GJG.11.71.G05.1.454.CMB.2.raw
  modified_base (251)..(251): a, c, t, g, unknown or other
  modified_base (264)..(264): a, c, t, g, unknown or other
  modified_base (290)..(290): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctntggcttcaccttnattaccatggcatgcacgtgggtccncagacctccgaggcgaggggctgggagtggggtgctagtttattcgatagtgataggaaatgtgtacttctattcaagtactccgtagaacgggctattccaccgtctaccagacacaatccaggcacgacgctagtactcgtgactaaagtcgaaacacgtaccgagtacggagtacccgtaggaacgggaccgacccgggtacgttagggttacgttaacgttttaaaccgtgggttaacgaaaccggttaaaacggttaacgtttaacttaaaggttaacggggtaggggttaccggtaaccggggtttaaccggggggtacgttttaaccgg

SEQ ID NO: 410428 - DNA, 624 bp, Homo sapiens
  misc_feature: GZ8MTXP02FSVWM.11.71.G05.1.454.CMB.2.raw
  modified_base (249)..(249): a, c, t, g, unknown or other
  modified_base (262)..(262): a, c, t, g, unknown or other
  modified_base (330)..(330): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcggtgtccagcctgggacgtcctgagactctctgtacagcctntggcttcaccttnattacctatggcatcgccacgtcgggtcccaccagtacctccgaggcgagggggctggggagtggggngctagtttattcatagtgataggaatgtctacttactattcgagtaccgtcggtaggaacgggtccctaaagttcccaccgtcctacccgtaagaacgtaactaaacttacccgacgggaaccaccgtacgtacttacgtactacttacgaactaaaatacgaaacctagacccgtagaagacgacgtaggacgacgacggtcgttagttacgtaattacggtagtacgtaacgtaaagttatttaacgtaagtaggtacgggtacggtacggtaaccggggttcgtttaacgg

SEQ ID NO: 410429 - DNA, 642 bp, Homo sapiens
  misc_feature: GZ8MTXP02GKYKW.11.71.G05.1.454.CMB.2.raw
  modified_base (254)..(254): a, c, t, g, unknown or other
  modified_base (266)..(266): a, c, t, g, unknown or other
  modified_base (296)..(296): a, c, t, g, unknown or other
  modified_base (303)..(303): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggaggagtcgtgggggaggcgtggtccagccgtgggacggtccctgagactctcctgtacagcctntggctcaccttnacttaccatggcatgcacgtgggtaccccncagaccncgaggcggaggggtcgtgggaggtgggtcgtcttaagtttattacatagtagtaagtaaggtaaatagtatactttacttatcgacgtaccgtacggaggaacgggtctactaccgtaccgtctacgaagtaagtaactaacgtaccgacgaccaacgtacgtactagtactacgtacgaactaaagtaacgaacgtacgtacgtagacgacgtacgtaggaacggacgtacggtacgttagtacgttaacgttacggtacgtaacgtaaacgtaaaagtttaatttaacgtaagtaacggtaagggtaccggtaaccgggttacggggtacgtttacg

SEQ ID NO: 410430 - DNA, 586 bp, Homo sapiens
  misc_feature: GZ8MTXP02IS93T.11.71.G05.1.454.CMB.2.raw
  modified_base (245)..(245): a, c, t, g, unknown or other
  modified_base (250)..(250): a, c, t, g, unknown or other
  modified_base (263)..(263): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagcctgggagtccctgagactctcctgtacngcctntggcttcaccttnattacctatgcatgcacgtggtccaccagactcgaggcgagggggtctggggaggtggggtcgacgtagtttactttcatagtgagtaggaaatgtacgtactttctattcgagtacctccggtagacggggtctattccacgtctcgagacgtacaactcacggacacgacgtcgtgtactctacgaactaaagtcgaaacacgtccgaggacgacgacgtaggaacgacgaccggtacgttgtagttagttaacgtggtacgaacggtaaagtttacttaagtagtaaggacggtacggaacggtttacggggacttttcg

SEQ ID NO: 410431 - DNA, 602 bp, Homo sapiens
  misc_feature: GZ8MTXP02GPIKA.11.71.G05.1.454.CMB.2.raw
  modified_base (252)..(252): a, c, t, g, unknown or other
  modified_base (264)..(264): a, c, t, g, unknown or other
  modified_base (269)..(269): a, c, t, g, unknown or other
  modified_base (293)..(293): a, c, t, g, unknown or other
  modified_base (332)..(332): a, c, t, g, unknown or other
  modified_base (334)..(334): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttccctcgttgctcttttaagaggtgtccagtgtcaggtgcaactggaggagtcggtgggggagcgtggtccagccgtgggacgtcctganctctcctgtacngcctngctcacttcattaccatgcatgcncgttggccccagacctcgaggcgaggggctggaggtggngntagtttattcattatgacgtaggaattgtatactttactattacgaagtacccgtaccggtaggaaacgggtccgtaacttccgaacccgtctccgaagtaacgaactacttccgaaggccaacgacgtctagtactcctagaacaaagtacaaacgcgaccgtagaacgacgtacgtaggaacggaacgtaccggggttacgttacggtattaacgttaacgtaggtaaacgtaacgttaaagttacgtttaacgttaagtaacggg

SEQ ID NO: 410432 - DNA, 577 bp, Homo sapiens
  misc_feature: GZ8MTXP02FH6A5.11.71.G05.1.454.CMB.2.raw
  modified_base (181)..(181): a, c, t, g, unknown or other
  modified_base (265)..(265): a, c, t, g, unknown or other
  modified_base (270)..(270): a, c, t, g, unknown or other
  modified_base (313)..(313): a, c, t, g, unknown or other
  modified_base (427)..(427): a, c, t, g, unknown or other
  modified_base (447)..(447): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcaacgtggaggagtcgtgggggaggcgtggtccaggccgtgggacgtccctgagctctcctgtacngcctntggtcttcaccttcacttacctatggcatgcacgtcgggtccnccagacctccgaggccgagggggctgggagtggggtcgctagtttactttcattagtgagtagggtaatgtgtactttctattcagtctaccgtagacggctattccaccgtcncagagactaactcgagcacncgtctgtaactcacgaacaaatacgaaacagtaccgtagaacgagaccgtaggaacggacgtacggtacgttagtacgttaacttaacgtacggttagaaacggtaaagttactttacgtaagtaacggg

SEQ ID NO: 410433 - DNA, 627 bp, Homo sapiens
  misc_feature: GZ8MTXP02F7FP7.11.71.G05.1.454.CMB.2.raw
  modified_base (247)..(247): a, c, t, g, unknown or other
  modified_base (252)..(252): a, c, t, g, unknown or other
  modified_base (294)..(294): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagccgtgggacgtccctgagactctcctgtacngcctntgcttcaccttcattacctatggcatcgctacgtcgggtccnccagtacctccggaggtcgagggggtctaggggaggtggggtagctaaggtttttacttcgaagttagtagtaagttacggaaaattcgtacgtacctttcgtaattcgaacgtaccgttccgtaggaacggtccgtaattcccgaccgtctaccgagagactaatccgagcacgacgtctacggtactacgtacgaactaagtacgaacgacgtacgtacgaagacgtacgcggaacggtacgacgggtactggttactagttacgtacgtaggaacgtaagttacttaacgtaagtacggtaggtacggaacggtacgggggtctttacgg

SEQ ID NO: 410434 - DNA, 571 bp, Homo sapiens
  misc_feature: GZ8MTXP02F2NM4.11.71.G05.1.454.CMB.2.raw
  modified_base (264)..(264): a, c, t, g, unknown or other
  modified_base (295)..(295): a, c, t, g, unknown or other
  modified_base (341)..(341): a, c, t, g, unknown or other
  modified_base (353)..(353): a, c, t, g, unknown or other
  modified_base (359)..(359): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagccgtgggagtccctgagactctcctgtacagcctctggcttcaccttnattacctatcggcatgctacgtcgggtcccncagcctccgaggcgaggggctgggagtgggtgctagtttattcatntgatagaatgtntacttntattcagactcggtagaacgggtcctattccgaccgtctaccagacaactagttccaggcacgacgactgtatcgtagactaaatacgaaacacgaccgtagacgacgtacgtaggaacggtaccgacggtctaggttagttacgttaacgtggtacgaacgtaagttacttaagtaagtagtaggtacgtacgggtacgggtactttacgg

SEQ ID NO: 410435 - DNA, 638 bp, Homo sapiens
  misc_feature: GZ8MTXP02I1VQ7.11.71.G05.1.454.CMB.2.raw
  modified_base (264)..(264): a, c, t, g, unknown or other
  modified_base (293)..(293): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttnattacctatggctatcgcactgggtcccnccagacctccgaggcgaggggctgggagtggggtgctagttattcatatgatagaaatgtgtacttctattcgagaccgttcgtagaacggggtcctaattccctaaccgtctacccgtagaacgtaacgtaaacttaccacggttaccacctaaccgtccgtgtaaacttccgtacgtaaccgtaaaagttaccgaaaacgacgtacccgttaggaacggtacggtacgtacggaacgggaccgaaccgggtccgttacgttagtacgtttacgtacgttaggtaacgtaaaggttatttaacgtaagtacggtaggtacggtacggtacgggggtctttacgg

SEQ ID NO: 410436 - DNA, 632 bp, Homo sapiens
  misc_feature: GZ8MTXP02I1XYC.11.71.G05.1.454.CMB.2.raw
  modified_base (314)..(314): a, c, t, g, unknown or other
  modified_base (543)..(543): a, c, t, g, unknown or other
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggacggtccctgagactctcctgtacagcctctggccttcaccttcattaccctagtcggcatcgctacgtcgggtcccnccagcctccgaggcgaggggctgggaggtgggtgctagtttacttcatagtgagtaggaaattgtgtacttctattcagtacctcgtaggaacgggtccgtattccaccgtcctaccgagaacgtactaacttaccgaggtaccacgtacgtcttacgttactccgttagaactaaagtacgaaaccgacgtacctaggaacgacgacgtaggaacggaccgtacggtnttacggttagttaactttacgtacggtacgtaacgtaaagttacctttacgtaagtaacggtaggttacggtaaccgggtttacggggg

SEQ ID NO: 410437 - DNA, 564 bp, Homo sapiens
  misc_feature: GZ8MTXP02I0VR3.11.71.G05.1.454.CMB.2.raw
  modified_base (265)..(265): a, c, t, g, unknown or other
  modified_base (270)..(270): a, c, t, g, unknown or other
  modified_base (291)..(291): a, c, t, g, unknown or other
  modified_base (306)..(306): a, c, t, g, unknown or other
  modified_base (324)..(324): a, c, t, g, unknown or other
  modified_base (328)..(328): a, c, t, g, unknown or other
  modified_base (342)..(342): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggagtccctgagactctcctgtacngcctnggcttcaccttcattacctangcatgcacgtggccncagctcgaggcgaggggntggngtggtgctagtttnttcatatgaagttaggaattgtgtacttgtactcgaagtacctccgtaggaacggccgtattccaccgtctccagtacgaactactccgaaggccaacgtacgtctagtactactacgactaaagtacgaaactcgtaccgagaacgacgtcgtagggacgacgacggtcgtagtacgttattaacgtaggtagtacgtaaagttgtttacgtaagttaagg

SEQ ID NO: 410438 - DNA, 605 bp, Homo sapiens
  misc_feature: GZ8MTXP02F7LTF.11.71.G05.1.454.CMB.2.raw
  modified_base (245)..(245): a, c, t, g, unknown or other
  modified_base (250)..(250): a, c, t, g, unknown or other
  modified_base (295)..(295): a, c, t, g, unknown or other
  modified_base (340)..(340): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccagccgtgggacgtcctgagctctctgtacngcctntggtcttcaccttcattacctatggctatcgcacgtcgggtcccncagacctccgaggcgaggggctgggagtgggtgctagtttacttnatatgataggaaatgtctacttctatcgagtactcggtagacggtctatccaccgtctaccagacactaatccgagtcacgacgtctagtactcagtaacaaagtacgaaacgacgtaccgtagacggtacgtacgtaggaacggtacgtacggtacgttaggttacgttagttacggtaggtaaacggtaacgttaaaagttacgttaacgttaaaggtagggtacgggttacggtacggggttaccggggtacgttttaccgg

SEQ ID NO: 410439 - DNA, 601 bp, Homo sapiens
  misc_feature: GZ8MTXP02JEUIV.11.71.G05.1.454.CMB.2.raw
  modified_base (248)..(248): a, c, t, g, unknown or other
  modified_base (254)..(254): a, c, t, g, unknown or other
  modified_base (293)..(293): a, c, t, g, unknown or other
  modified_base (317)..(317): a, c, t, g, unknown or other
  modified_base (430)..(430): a, c, t, g, unknown or other
  modified_base (471)..(471): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccaggcctgggacgtccctgacgctctcctgtacngcctgngtcttcaccttcattaccagtgcatgcacgtcgggtccncagcctcgaggcgaggggctaggnggtgggtgacgttagtttattcatagtgtaacgtagtaaatgtcgactttctaattcgagttaccgtcggagacggtctattccaccgtcacagacgacacgtcagcacacgntatctcctagaactaaatacgaacgacgtaccgagaacggngtacgagggacggaaccgcgttacgtacggtttacgttaacgttacgttaggtaccgtaacggtaaagttagtttaacgtaagttacgggtacgggtacggtaccgggtttaccgggggtcttttacggg

SEQ ID NO: 410440 - DNA, 630 bp, Homo sapiens
  misc_feature: GZ8MTXP02HKHCR.11.71.G05.1.454.CMB.2.raw
  modified_base (255)..(255): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagtcttgggttttcctcgttgcttcttttaagaggtgtccagtgtcaggtgcaacgtgggaggagtcgtggggggaggcgtggtccaggccgtgggacgtccctgagactctcctgtaccngcctgtgcttcaccttcattacctatggcatcgctacgtcgggtcccaccagacctcgagggcggagggggctggggacggtggggtggtactagtttacttcattagtgagtaggaaattgtagtacttctatcgagtactccggtagaacgggtcctaagttcccaccgtctacccgagacgtaactaacttccgaggacctacgacgtacgtgtaactcgtacgactaaagtacgaaacgacgtaccgtaggacgagtcgtaggacggaacgacgggtcttaggttagttacgttacgtacggtacgtaacgttaaagttacgtttaacgtaagtacggtacgggtacgtaccggggtcgggttacgtttcg

SEQ ID NO: 410441 - DNA, 613 bp, Homo sapiens
  misc_feature: GZ8MTXP02FWKLQ.11.71.G05.1.454.CMB.2.raw
  modified_base (293)..(293): a, c, t, g, unknown or other
  modified_base (359)..(359): a, c, t, g, unknown or other
  modified_base (374)..(374): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggaggtcgtgggggaggcgtggtccagcctgggaggtccctgagactctcctgtacagcctctggtcttcaccttcattacctatggcatgcacgtgggtccnccagactccgaggcgagggggctggagtggggtgcagtttattcatatgatagaaatgtgtacttntattcgagactcggngaacggggctagttccaccgtctccaagacgactaattccgaggcacgacgtctagtactctgaactaaagtagaaacgacgtacccgtggaacgacggtacgtacggaacgggtaaccgaacggtcgttaggttagttacgtttaacggtaggttacgtaaacgtaaaaggttaacctttaacgttaagttaacggtagggttacggtaacgggtaaccgggggtcttttaacccggg

SEQ ID NO: 410442 - DNA, 584 bp, Homo sapiens
  misc_feature: GZ8MTXP02FE6ZY.11.71.G05.1.454.CMB.2.raw
  modified_base (201)..(201): a, c, t, g, unknown or other
  modified_base (248)..(248): a, c, t, g, unknown or other
  modified_base (310)..(310): a, c, t, g, unknown or other
tcagcgagagataccacgaccggtgctcgatttagtgtcgtcgcaagagagaggggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtncaactggaggagtcgtgggggagcgtggtccagccgtgggagtcccngagactctcctgtacagcctctggcttcaccttcacttacctatggcatgcacgtgggtccncagacctccgaggcgagggggctgggaggtggggtggtctaggtttatttcatataggatgggaatgtagtactttctatttcgaagtacgtaccgttaggaaacgggtccgtacttcacccgtctacccgagacgaactaacttccgaaggcacacgtctgtaactctacgacaaacgtagaactacgccgtagaagagtcgtaggaacggacgacgtacgttcgtagttactaacgtggtacgtacggtaaaattacgttacgtagtaaggg

SEQ ID NO: 410443 - DNA, 519 bp, Homo sapiens
  misc_feature: GZ8MTXP02FNXRN.11.71.G05.1.454.CMB.2.raw
  modified_base (247)..(247): a, c, t, g, unknown or other
  modified_base (251)..(251): a, c, t, g, unknown or other
  modified_base (260)..(260): a, c, t, g, unknown or other
  modified_base (265)..(265): a, c, t, g, unknown or other
  modified_base (267)..(269): a, c, t, g, unknown or other
  modified_base (271)..(271): a, c, t, g, unknown or other
  modified_base (277)..(278): a, c, t, g, unknown or other
  modified_base (281)..(281): a, c, t, g, unknown or other
  modified_base (284)..(284): a, c, t, g, unknown or other
  modified_base (286)..(286): a, c, t, g, unknown or other
  modified_base (288)..(288): a, c, t, g, unknown or other
  modified_base (291)..(292): a, c, t, g, unknown or other
  modified_base (295)..(295): a, c, t, g, unknown or other
  modified_base (299)..(300): a, c, t, g, unknown or other
  modified_base (305)..(305): a, c, t, g, unknown or other
  modified_base (307)..(307): a, c, t, g, unknown or other
  modified_base (310)..(310): a, c, t, g, unknown or other
  modified_base (326)..(326): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagtctgggttttcctcgttgctcttttaagaggtgtccagtgtcaggtgcaacgtggaggagtcgtgggggagcgtggtccagccgtgggacgtcctgagactctcctgtacngctntgctcactnatctngnnncngtcgcnngcncgngngnggnnggngtgnntattntnatngagtagatgtctactntatcagtcgtcgtagacgtctactccaccgtcacagacactacgtacacgcacgacgtctagtactcagaactaagtacgaacgacgacgtagagcgacgaggacgacgcggtacgtagttagtacgttcgtagtacgtaacgtaagttattaagtaagtacggtacggtacggtacggtacgggtacttacg

SEQ ID NO: 410444 - DNA, 559 bp, Homo sapiens
  misc_feature: GZ8MTXP02GIRF5.11.71.G05.1.454.CMB.2.raw
  modified_base (247)..(247): a, c, t, g, unknown or other
  modified_base (252)..(252): a, c, t, g, unknown or other
  modified_base (274)..(274): a, c, t, g, unknown or other
  modified_base (428)..(428): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccaggccgtgggaggtccctgagactctcctgtacngcctntggcttcaccttcattacctangcatgcacgtggtcccgcagacctcgaggcggaggggctgggaggtgggtcgctagtttattcatagtgagtaggaaatgtagactttctattcgagtacgtccggtagaacggtccaattcccaacgttcaccaagacgactatccgagacanacgctgtactcgagtacaaatgaacataccgtgacgagtcaggagacgacgtcttagtacttatacggtagtagaacgttaaagtactttaaggaataggtaggtacgtaacggggtacgggtctttacgg

SEQ ID NO: 410445 - DNA, 674 bp, Homo sapiens
  misc_feature: GZ8MTXP02F8Z1K.11.71.G05.1.454.CMB.2.raw
  modified_base (247)..(247): a, c, t, g, unknown or other
  modified_base (252)..(252): a, c, t, g, unknown or other
  modified_base (294)..(294): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggaggagtcgtgggggaggcgtggtccagccgtgggacggtcctgagactctcctgacngcctntggcttcaccttcattaccatggcatcgcacgtcgggtcccncagacctccgaggcggagggggctgggacggtgggtggtctaggtttattcatagtgaataggaaattgtcgtacttctattcacgtacgttacggtaggaacggtccgtaacgttcccaccgttcctaccgagaacgtaccttaaacgtaccgacgggtacaacccgtcgtaccttagttaaccgttaccgttaggaaacctaaaacgttacgaaaccgtacgtacccgtaggacggaacggttacgagggaaacggaccgaacgggtcgttcgttaacggttagttaccggtgtaacgggtaacgttaaaaggttactttaagtaaggtaagggttacgggtacggtaacggggtccgggggtttactttaaccgggg

SEQ ID NO: 410446 - DNA, 559 bp, Homo sapiens
  misc_feature: GZ8MTXP02JCXA0.11.71.G05.1.454.CMB.2.raw
  modified_base (301)..(301): a, c, t, g, unknown or other
  modified_base (488)..(488): a, c, t, g, unknown or other
tcagcgagagataccacgaccggtgctcgatttagtgtcgtcgcaagagagaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggagtccctgagactctcctgtacagcctctggcttcaccttcattacctatggcatcgcactcgggtcccnccagacctccgaggcgaggggctgggagtgggtgctagttattcgatactgatggaaaattgtgtacttctattcgaagacttccggtgaaacgggtccgtaattccaccgtctaccgagacgactaacttccgaagtcacacgctgtatctagacaaatcgaacagctagacgagctagacggacncggctcgtagtacgttacgtagtcgtaacggaaatatttacgtaagtaggtagtacggtacgttacggggg

SEQ ID NO: 410447 - DNA, 592 bp, Homo sapiens
  misc_feature: GZ8MTXP02F0MDR.11.71.G05.1.454.CMB.2.raw
  modified_base (244)..(244): a, c, t, g, unknown or other
  modified_base (262)..(262): a, c, t, g, unknown or other
  modified_base (273)..(273): a, c, t, g, unknown or other
  modified_base (287)..(287): a, c, t, g, unknown or other
  modified_base (312)..(312): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggacgtccctgagactctctgacngcctctgtcttcaccttnattactatgcntgcacgtcggtccncagacctcgaggcgaggggctgggngtgggtgtctagtttattcatatagtagtaggtaaatgtacgtacttacgtatcgatacgtcggtagacggctattccgaccgtctaccgagacgaactacgtaccgacgacacgacgtctgtactcgtacgaacaagtacgaaacgacgtacccgtagaacgacgacgtaggaacggacgtacggtacgttagttagttacgttacgttaggtaacgtaacgtaagttaattaacgtaagtaaggtacggtacggtacgggtacggggttctttaacgg

SEQ ID NO: 410448 - DNA, 679 bp, Homo sapiens
  misc_feature: GZ8MTXP02JSVJB.11.71.G05.1.454.CMB.2.raw
  modified_base (326)..(326): a, c, t, g, unknown or other
  modified_base (478)..(478): a, c, t, g, unknown or other
  modified_base (509)..(509): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagtcttgggttttcctcgttgcttcttttaagaggtgtccagtgtcaggtgcaacgtgggaggagtcggtgggggaggcgtggtccagccgtgggacgtccctgagactctcctgtacacgtcctcgtcggtccttcaccctttcaactttaccctagtcggacacgtcggacctaccggtcggggtccccnccgtaacggacctcccggagggccggagggggtcgtaggggtacggtggggtagtacgttaggtttacttacagtagtagtaagtaggtaaaattgtactacttatattccgagtacgtccggtagtacgggtcctattcccgtaccgtccncgaagacgaacaacgttaccgacgcgaaccncgtactgttactcgacgtaactaagtaccgaacacgacgtacggaaggtacgacgagggaccgacggaacggtcgtagtacgtacgttacgtaggtacgtaacgtaaagtttagttaagtaacggttacggtacggtacggtaccggggtttacggggtacgtttaccgg

SEQ ID NO: 410449 - DNA, 538 bp, Homo sapiens
  misc_feature: GZ8MTXP02JW9TW.11.71.G05.1.454.CMB.2.raw
  modified_base (262)..(262): a, c, t, g, unknown or other
  modified_base (267)..(267): a, c, t, g, unknown or other
  modified_base (307)..(307): a, c, t, g, unknown or other
  modified_base (337)..(337): a, c, t, g, unknown or other
  modified_base (344)..(344): a, c, t, g, unknown or other
  modified_base (346)..(346): a, c, t, g, unknown or other
  modified_base (350)..(350): a, c, t, g, unknown or other
  modified_base (431)..(431): a, c, t, g, unknown or other
  modified_base (460)..(460): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggagcgtggtccagccgtgggacgtccctgagctctctgtacngcctntggcttcaccttcattacctatggcatgcacgtgggtccncagctccgaggcgaggggctgggagtgggngcagttntnatangatggaatgagtacttcgattcagtctccgtaggaaacggtcctattccaccgtctaccgagacgactattccgagcaacncgtctagtactcgtagaacaaatcgaacngacctagacgtacgcgtagaacggacgacggtctgtagttaataacgtggtacgacgtaaagtctttacgagtaaggg

SEQ ID NO: 410450 - DNA, 649 bp, Homo sapiens
  misc_feature: GZ8MTXP02JOISW.11.71.G05.1.454.CMB.2.raw
  modified_base (181)..(181): a, c, t, g, unknown or other
  modified_base (296)..(296): a, c, t, g, unknown or other
  modified_base (342)..(342): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcaaactgggaggagtcgtgggggagcgtggtcagcctgggagtccctgagctctcctgtacagcctctggcttcaccttcattaccatggcatgacncgtcgggtccgccagacctccgaagggccgaggggggctacggggnggtggggtggactaggtttacttacattagtagtaagttagggaattggtacgtacttctaattacgacgtacctaccggtaggaacggtcccgtaactccgacccgttccaccgaacgaacgtaactacgttacccgaacggacccacgtaccgtctagttactacgtacgacgtaaacgtacgaaacgaccggtactagaacggacgtaccggtaggaaacgggaccgtacgggtacgttacggttacgttacgttaacgtaggttacggaacgtaaaagtttacgtttacgtaaggtttaacgg

SEQ ID NO: 410451 - DNA, 782 bp, Homo sapiens
  misc_feature: GZ8MTXP02JITXP.11.71.G05.1.454.CMB.2.raw
  modified_base (373)..(373): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagtctgggttttcctcgttgcttcttttaagaggtgtccagtgtcaggtgcaactggaggagtcggtgggggaggcgtggtccaggcccgtggggacggtccctggacgtactctccgtgtacacgtcctcgtcggtccttcaccttctacttaccctagtcggcatcgccgtacggtcgggtcccgcccaggacctccggaggcggagggggctgggaggtggggtaggtctagtttnttacagttagtgaagtaggtaaattgttacgtacttcgttactcgacgtaccgttccgaggtaacggcctactcccgaccgtctaaccgagtaacgacctaacgtacccgaacggaccaaccgtacgtaccgttagttaaccttccgaacgaaacccgttaaaagaccggtaaaaccgtaccgaacccgttaagggaacggtaaacggttaccggaacgggttaaaccgggaacccggttaaccgggttcgttacggtttaaagggttaacctttaaacggggtttaggaaacgggttaaaaccggttaaacggttttagttttaaccgtaaagggtttaacgggtaaaccgggggttacggggtaaaccccgggggtttaacgggggtttccggtttttaaacccggg

SEQ ID NO: 410452 - DNA, 520 bp, Homo sapiens
  misc_feature: GZ8MTXP02JGAYO.11.71.G05.1.454.CMB.2.raw
  modified_base (302)..(302): a, c, t, g, unknown or other
  modified_base (364)..(364): a, c, t, g, unknown or other
  modified_base (368)..(368): a, c, t, g, unknown or other
  modified_base (370)..(370): a, c, t, g, unknown or other
  modified_base (373)..(373): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcgtgggtttcctcgttgctctttaagaggtgtccagtgtcaggtgcaactggagagtctgggggagcgtggtcagcctgggagtccctgagactctctgtacagcctgtggcttcaccttcattacctatggcatgcacgtagggtccncctagactaccaggcagggggctggacgtggtggcagtattcatatgatgaatcgtgacttntatnanacngagagcatcgctcacagacgacactcgagacacgacgctagtactactagacaaactaacgaacacacacgagacgacgagacgtaacgacgtacgtacgtacgtagtaacgtacgacgtacgaaagtaacgttaacgttaagtaag

SEQ ID NO: 410453 - DNA, 646 bp, Homo sapiens
  misc_feature: GZ8MTXP02GY6UJ.11.71.G05.1.454.CMB.2.raw
  modified_base (247)..(247): a, c, t, g, unknown or other
  modified_base (252)..(252): a, c, t, g, unknown or other
  modified_base (296)..(296): a, c, t, g, unknown or other
  modified_base (327)..(327): a, c, t, g, unknown or other
  modified_base (336)..(336): a, c, t, g, unknown or other
  modified_base (355)..(355): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggccagccgtgggacgtcctgagactctcctgtacngcctntgcttcaccttcacttacctatggcatcgctacgtcgggtcccnccagactccgaggcgaggggctggagtgggngctagtttntcatatcgataggaattgngtacttctatcagtactccggtagacgggcctatccaccgtctaccgagaacgactaacttccgaacggacaacctacgactagttaactccgtagaacctaaagtacggaaacctacgaccgtaggaagacgaccgtaggaacgggtacgaaccgggtcgttacgttagttaacgtttaccgtaggtttacgaaaccgttaaaagttaaccgttttaacgtaaaacggtttaacggggtaaacgggttacggtaaaccggggtttacgggggaacccgtttttaaccggg

SEQ ID NO: 410454 - DNA, 621 bp, Homo sapiens
  misc_feature: GZ8MTXP02GZ17D.11.71.G05.1.454.CMB.2.raw
  modified_base (246)..(246): a, c, t, g, unknown or other
  modified_base (264)..(264): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacngcctctggcttcaccttnattacctatggcatgcacgtgggtccgccaggtacctccgagggcgagggggctgggagtggggtggctaggtttatttcattagtgtagtagggaaaatagtgtactttcttattcagtacttcgtgaaagggccgtattccgaccgtctccacgagacaattccaggcacgacgctgtactctagactaaagacgaactagccctaggagacgcgtaggaacggaacgcgggtcgttggtaggttactttaaacggtggttaacggtaacgttaaagttaagtttaacccgttaaaggttaacgggtaaggggttaccggtaaccggggtttaaccggggggttccttttacggg

SEQ ID NO: 410455 - DNA, 666 bp, Homo sapiens
  misc_feature: GZ8MTXP02HCBQ2.11.71.G05.1.454.CMB.2.raw
  modified_base (184)..(184): a, c, t, g, unknown or other
  modified_base (315)..(315): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagtcttgggttttcctcgttgcttcttttaagnggttgtccagtgtcaggtgcaacgtggaggagtcgtgggggaggcgtggtccagccgtgggacgtccctgagctctcctgtacacgcctctggcttcaccttcattacctatggcatgcacgtcgggtccncagacctccgaggcgaggggctgggacgtggggtggctaggtttattcgattagtgtaagtagggtaattgttgtaactttcttaattcaacgtacctccgtaggaacgggtacccgtattaccgacccgttctaccgaagacgaactaaacgttccgaacgggaccaacgtaccgtcgttacgtacgttcctaggtaaccaaattacgaaactacgtcccgtaggaacgtacggacccgttagggaaccgggtaacgtaaccggggtccgttacggttacgtttaaagttaaccggttaggtaaccggtaacggtaaaagtttacgttttacgtaaggtttaaacggggg

SEQ ID NO: 410456 - DNA, 643 bp, Homo sapiens
  misc_feature: GZ8MTXP02JDJLU.11.71.G05.1.454.CMB.2.raw
  modified_base (270)..(270): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaaagaggtgtccagtgtcaggtgcaactgggaggagtcgtggggggagcgtggtccaggcctgggagtccctgagctctctgtacagcctntggcttcaccttcattaccatggactagtcgcacgtgggtcccacagacctcagtcgagggggctggagtgggtggactagttattcgattagtgaataggaatcgtagtactttatactttcgaacgtaccgtaccgtaggaaacggggccctaagttacccgtacccgttacctacccgaagaacgtaacctaaacgttccaaacgggtccaaccgacgtaccttagtaacttcccgtaagaactaaagtacgaaaccgtacgaccgtagaacggaacgtacgtaggaaccggaacgtaccggttacgtacggttacgttaacgttaacgtaggtaacgtaacgtaaaagtttacgtttacgtaagtaagg

SEQ ID NO: 410457 - DNA, 607 bp, Homo sapiens
  misc_feature: GZ8MTXP02I8H9Z.11.71.G05.1.454.CMB.2.raw
  modified_base (245)..(245): a, c, t, g, unknown or other
  modified_base (256)..(256): a, c, t, g, unknown or other
  modified_base (299)..(299): a, c, t, g, unknown or other
  modified_base (324)..(324): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaaactgggaggagtcgtggggggagcgtggtccaggccgtggggagtccctgagactctccngtacagtcctntggcttcaccttcattaccatggcagtgccacgtcgggtcccnccagctccgaggcgagggggctggnggtgggtgctagttattcatatgataggaaatgtgtacttgtatcgagtactcgtgaacgggtccatttccaccgtctaccgagacgaactactacgacggtacacgacgtctcgtaactcgtagtaacctaaagtacgaaactagacccgtaggaacgacgtacggttaggaacgggtacgtaaccggtcgttggttaacgttacgtttacgaaggttcgaacggttaaatacgtttaacgtaggtaacggttaggacggtacggtacggggtactttacgg

SEQ ID NO: 410458 - DNA, 942 bp, Homo sapiens
  misc_feature: GZ8MTXP02F5UYD.11.71.G05.1.454.CMB.2.raw
tcagcgagagataccacgaccggtgctcgatttagtgtcgtcgcaagagagaggggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcggtgggggaggcgtggtccagccgtgggacgtccctgacgacttctcctgtacacgtccctcgtcggtccttacctacctttctaacttaccctagtcggctatcggacctaccggttcggggtccccaccgaacgtacccttacccggaaggttacccggggagggggggtccgttgggggtaaggggttcgggggtacggtacgttaagggtttttaaccttttacgaagtttagttaggtaaagttaggggtaaacttacgggttacggttaaaccttttccgttaaacgttttaccgaaaccgggttacccgtttaaccccgggggtaaggggtaaaccccgggggttaccccgttaaacgttttacccccgtaaacccccggggttaccctaacccccggtaaaacggggtaaacccgttaaaacccttaaaaaccggtttcccccggaaaacggggtaacccccaaaacccgtaaccccgggttactttaaccgggttaaaccctttacccggttaacgggaaaaccctaaaaaggttaccgggtaaaacccgacgttaaccccggtagggaaaaccggtaggacccgggttaagggaaacccggggaaccgtaaaccggggttccgttaacgggttaagttttaaaccgtttaaccggtagttaaccgggtaaaaccggtttaaaagtttacgtttaacggtaaaggtttaaacggggg

SEQ ID NO: 410459 - DNA, 660 bp, Homo sapiens
  misc_feature: GZ8MTXP02H4FUX.11.71.G05.1.454.CMB.2.raw
  modified_base (251)..(251): a, c, t, g, unknown or other
  modified_base (258)..(258): a, c, t, g, unknown or other
  modified_base (298)..(298): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtggggggaggcgtggtccaggccgtggggaggtccctgagactctcctgtacngcctcgnggcttcaccttcattacctatggcatgcacgtcgggtccnccagcctccgaggcgagggggtctgggaggtggggtggctaggtttacttacatagtgaatagggaaaattgtagtactttcgtaattcagtacctccgggtagaacggggtccgtattccctaccgtctaccgagaacgactaaacttaccgacggacaacgaaccggtctaggttactcttacggaactaaacgtaggaaacctacgcccgttaggaacggagtacgtacggaacgggaaccggacggtaccgttgttacggtttaaacttacggtaggtaccgaaacggttaaagttaacgtttaacgtaaaggtaacggtaaggggtaggtaccggggttacgggggtacttttcggg

SEQ ID NO: 410460 - DNA, 671 bp, Homo sapiens
  misc_feature: GZ8MTXP02ISP37.11.71.G05.1.454.CMB.2.raw
  modified_base (248)..(248): a, c, t, g, unknown or other
  modified_base (253)..(253): a, c, t, g, unknown or other
  modified_base (266)..(266): a, c, t, g, unknown or other
  modified_base (279)..(279): a, c, t, g, unknown or other
  modified_base (295)..(295): a, c, t, g, unknown or other
  modified_base (345)..(345): a, c, t, g, unknown or other
  modified_base (612)..(612): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggtttcctcgttgctctttaagaggtgtccagtgtcaggtgcaacgtggaggagtcgtggggggaggcgtggtccaggccgtgggacggtcctgagactcctctgtacngcctntgtcttcaccttntacttaccatgcntcgctacgtcgggccnccagacctccgaggcggagggggctgggagggttgggtggtcttagtttnttacagttagtggaagtaggaaattgtacgttactttaccgtattcggagtacccttcgggtacggaaccggggtccctaagttcccgacccgttaccgtaccgagtaacgaacgttaaccgttaccgaaccggctaaccgaccgtcttagttactacgttacgaactaagtacgaccgacgtccgtaggacgtcggtacgtagggacggacgtacggtacgttaggttagttacgtttaggtacggttacggtaacgttaaagttntttaacggtagtacgggttacgggtacggtaaccggggttacggggttaccgtttacgg

SEQ ID NO: 410461 - DNA, 581 bp, Homo sapiens
  misc_feature: GZ8MTXP02JUY93.11.71.G05.1.454.CMB.2.raw
  modified_base (307)..(307): a, c, t, g, unknown or other
  modified_base (354)..(354): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggaggcgtggtccaggccgtggggaggtccctgacgactctcctgtacagcctctggtccttcacccttcacttaccctagtcggcatcgccacgtcgggtccncctagacctccgagggcgagggggctggggaggtggggtgctagttnttacatagtgagtagaatgtagtacttctatcgagtcgtccgtagaacgggcctatccacgtctacgagacgacactacacgcacgcgtactgtactctagactaagtacgaacacgaccgtagaacgacgacgtacggacgtacgacggtcgtagtcgtacgttacgtgtacgacgttaagtacttaagtagtaggtacggtacgtacggtacggggtctttacgg

SEQ ID NO: 410462 - DNA, 579 bp, Homo sapiens
  misc_feature: GZ8MTXP02I7A7P.11.71.G05.1.454.CMB.2.raw
  modified_base (252)..(252): a, c, t, g, unknown or other
  modified_base (296)..(296): a, c, t, g, unknown or other
  modified_base (304)..(304): a, c, t, g, unknown or other
  modified_base (322)..(322): a, c, t, g, unknown or other
  modified_base (341)..(341): a, c, t, g, unknown or other
  modified_base (483)..(483): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtggggggaggcgtggtccagccgtggggacggtccctgagactctcctgtacngcctctgcttcaccttcattacccatggcatgcacgtgggcccnccagaccncgaggcgaggggctgggnggtgggtgctagtttcttnatatgataggaaatgtgtactttctattcagtaccgtccgtaggaacgggcctaattcccaccgtctcgagacgacatccgagcacacgctcgtatctgaactaaagtacgaactacgacctaggagagcgtaggacggacncggtactgttagttacttacgtgtacggtaaacgtaaagttagtttaacgtagtagggtacggtacggtaaccgggttgggggtacttttaccggg

SEQ ID NO: 410463 - DNA, 657 bp, Homo sapiens
  misc_feature: GZ8MTXP02F0339.11.71.G05.1.454.CMB.2.raw
  modified_base (248)..(248): a, c, t, g, unknown or other
  modified_base (298)..(298): a, c, t, g, unknown or other
  modified_base (366)..(366): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggaggagtcgtggggggagcgtggtccagcctggggaggtccctgagactctcctgtacngcctctggcttcaccttcattacccatggctatgccacgtcggggtcccncaaggcctccgagggcgagggggctgggagtcggggtgctaggtttattcatatgataggaaaatgtntacttctattcaagtactccggtagaaacggggtccaattccacccgtctacccgaagacgtaactaacttcccgacgggacctaaccgaacgtccgttagtaacttaccgtggtaaccctaaaagttacgaaaaccgtacgaccccgttaggaaggacgaccgtagggaacgggaaccgtaacggggtcttaggtggttaacttacggtgttacggaacgtaaaagttagtttaacgtaagtaacggtaaagggttcggtaacggggttaccgggggtacgttttaccgg

SEQ ID NO: 410464 - DNA, 633 bp, Homo sapiens
  misc_feature: GZ8MTXP02GSFMQ.11.71.G05.1.454.CMB.2.raw
  modified_base (249)..(249): a, c, t, g, unknown or other
  modified_base (262)..(262): a, c, t, g, unknown or other
  modified_base (291)..(291): a, c, t, g, unknown or other
  modified_base (323)..(323): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagccgtgggagtcctgagactctctgtacagcctntggcttcaccttnacttacctatggcatgcacgtcgggtccnccagacctccgaggcgaggggctggagtgggngctagtttattcatagtgagtaggaaaatgtagtacttcgtatttcgaacgtacttccggtagaacggggtccctaatttcccgacccgtcctacccgaagtaacgaacgtaaacttcccgaacggaccaaaccgaccgtcgttacgttaaactccgtagtaacctaaaagttacgaaaccgtacgaccgtagaaggaacgtacgtaggacggacgacgtcgtaggtacgttaacttacgtagtacgaacgtaaagttatttaacgtaagtaaggtacggtacggtaaccggtacgggggtacgtttacg

SEQ ID NO: 410465 - DNA, 713 bp, Homo sapiens
  misc_feature: GZ8MTXP02I5YQV.11.71.G05.1.454.CMB.2.raw
  modified_base (250)..(250): a, c, t, g, unknown or other
  modified_base (294)..(294): a, c, t, g, unknown or other
  modified_base (325)..(325): a, c, t, g, unknown or other
  modified_base (371)..(371): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtggggacgtccctgacgactctcctgtacngcctctggcttcaccttcattaccatggcatgcacgtgggtccncagacctcgaggcgaggggctgggagtgggngctagttattcatagtgaagttagggaaaacttggtactacctttntattcgaacgtccgttaccggtaggaaccgggtcctaattcccgtacccgttccaccgtaacggaacgtaaaccctaaacgttacccgaaggaccctaacgtaacccggtacgttacggttaaccttaccgtaaacggtaaccttaaaacgttaccggtaaaccgaacggtcccttaagggaacggacgtaccggtagggaaaccgggaaccgtacgggtaccgttaggtttacgttaaatttaccggtacggttacgtaaaacggtaagtttaacgttttaacgaaaaggttagggttaacgggtacgggtaaccgggttacgggggtacccttttaacgg

SEQ ID NO: 410466 - DNA, 624 bp, Homo sapiens
  misc_feature: GZ8MTXP02IK3KB.11.71.G05.1.454.CMB.2.raw
  modified_base (264)..(264): a, c, t, g, unknown or other
  modified_base (269)..(269): a, c, t, g, unknown or other
  modified_base (279)..(279): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggaggagtcgtgggggaggcgtggtccagccgtgggagtccctgagactctcctgtacngcctngctcaccttnattacctatcggctatgctacgtcgggtcccaccagacctccgagggccgagggggctggggagtggggtgctagtttacttcaattatagtaacgtaggtaacgttgtagtactttactattcgaagtacccgtaccgtggaaacgggtctacttcgtacccgtctacccaggaacgtaactaaacgttccgaacggtaccaacaccgtcttagtactactagaactaaatacgaaacagtacctaaggaacgacgccgtaggaaacgggtacgacggtcgttacggttattaaccgttaagtaggtaacgtacggtaaaattacgtttacgaaagtaacgggg

SEQ ID NO: 410467 - DNA, 641 bp, Homo sapiens
  misc_feature: GZ8MTXP02GEZ3X.11.71.G05.1.454.CMB.2.raw
  modified_base (257)..(257): a, c, t, g, unknown or other
  modified_base (277)..(277): a, c, t, g, unknown or other
  modified_base (576)..(576): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaaggaggtgtccagtgtcaggtgcaacgtgggaggaggtcggtggggggaggtcgtcggtccgagccgtggggacggtcctgagactctcctgtacncgcctgtgtcttctaccttntacttacctagtggacatgactacgtcgggtccaccagacctcgaggcgagggggctggggaggtggggtcgtctaaggttttacttcgaattagtagtacgtaagtaaagtgtacgtacttatattcgacgtacctcgggtagaacgggcctattcccaccgtctaccgaacgtaagactaacttccgacggaccaacgacgtcctagttactacgtagaacctaaagtacgaaacgacgcccgtaggaacgtacgacgtaggaacgggacgacggtcgttaggtagttaacttacgngttacgaacgttaaagtattaacgttaagtaggtacggtcgtaacgggtcggggtacgtttacgg

SEQ ID NO: 410468 - DNA, 671 bp, Homo sapiens
  misc_feature: GZ8MTXP02J2NU1.11.71.G05.1.454.CMB.2.raw
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggacgtccctgagactcctcctgtacacgtcctcgtggccttcgaccttcattaccctatcggcatcgacacgttcgggtcccgccaggacctccgaacgggtcgagggggtcctggggagggtgggtcggtcctagtttacttcagtagtgatacggtaagtcgtacgtacctttctattaccgtaacgtccgtacccgggttaggaaaccggggtacccgttagttacccgtacccgggtccttaccggaacgtaacggtaaacccttaacgtttacccgaacggggtacctaacccgacggtaccttagggttaccttacggtactacgtaaaacttcggaacgtacgtccgtaagacgtacgacgtacggacggtacgaccgtgtaccgtagttactgtcgagtacgtaaagtcttaacgtagtaacggg

SEQ ID NO: 410469 - DNA, 642 bp, Homo sapiens
  misc_feature: GZ8MTXP02FHNST.11.71.G05.1.454.CMB.2.raw
  modified_base (251)..(251): a, c, t, g, unknown or other
  modified_base (344)..(344): a, c, t, g, unknown or other
  modified_base (364)..(364): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggaggagtcgtgggggaggcggtggtccagccgtggggacggtcctgacgactctcctgtacncgcctcgtcgtctcaccttcacttacctatcggcatgactacgtcgggtcccaccagacctccgaggccggagggggtctgggaggttggggnggctaggtttattcatagtnagtagtaatagtgtacttctattcagtaccgtcggtaggacgggtaccgtacttccgtaccgtcctaccgagaacgtactaaacgttccgagaccaaccgacgtaccttagtaactctacgaacctaaaagtacgaaacgtacgaccgtaggaacggcgtacgaggaaacggacgaacgggtcttaggttacgttaacgttacgtaggtacgtaaacgaaagttactttaagtaagtaacggtaggggtacgtaccgggtacgggggtacgtttacgg

SEQ ID NO: 410470 - DNA, 578 bp, Homo sapiens
  misc_feature: GZ8MTXP02IUZ8U.11.71.G05.1.454.CMB.2.raw
  modified_base (243)..(243): a, c, t, g, unknown or other
  modified_base (288)..(288): a, c, t, g, unknown or other
  modified_base (402)..(402): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctctgtacngcctctggcttcaccttcattaccatggcatgcacgtgggtcccnccagacctccgaggcgagggggctggagtggggtgctagtttattcatatgataggaaatgtgtacttctatcacgtactccgtagaacgggctattccaccgtctaccagaanactaacttccgaagacaaacgtctagtactctagacaaaagttgaaaccagaccgtagacgagtcgtaggacggacacggtctagtagttacttacgtaggtacgtaacgtaaaagttctttacgtaagtaggtacggtacggtaaccgggttacggggtcgtttacgtttaacgg

SEQ ID NO: 410471 - DNA, 550 bp, Homo sapiens
  misc_feature: GZ8MTXP02HUE1W.11.71.G05.1.454.CMB.2.raw
  modified_base (337)..(337): a, c, t, g, unknown or other
  modified_base (371)..(371): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacagcctctgcttcaccttcattcctatggcatgcacgtcgggccgccagacctccgaggcgaggggctgggagtgggngctagttattcatagtgataggaatgtgactttntatcagtctcgtagaggcgtatcgtaccgtctaccgagacgacacttccgacgcacacgctgtactcctagacaaatagaacgacgtcctagagacgacgtaggacgacgacggtcgtacgttagttaacgttaacgttagtacggtaacgtaaaaggttattttacgtaagttaaggg

SEQ ID NO: 410472 - DNA, 514 bp, Homo sapiens
  misc_feature: GZ8MTXP02F1SFV.11.71.G05.1.454.CMB.2.raw
  modified_base (197)..(197): a, c, t, g, unknown or other
  modified_base (244)..(244): a, c, t, g, unknown or other
  modified_base (249)..(249): a, c, t, g, unknown or other
  modified_base (288)..(288): a, c, t, g, unknown or other
  modified_base (343)..(343): a, c, t, g, unknown or other
  modified_base (363)..(363): a, c, t, g, unknown or other
  modified_base (416)..(416): a, c, t, g, unknown or other
  modified_base (431)..(431): a, c, t, g, unknown or other
  modified_base (435)..(438): a, c, t, g, unknown or other
  modified_base (440)..(440): a, c, t, g, unknown or other
  modified_base (442)..(442): a, c, t, g, unknown or other
  modified_base (444)..(444): a, c, t, g, unknown or other
  modified_base (446)..(446): a, c, t, g, unknown or other
  modified_base (448)..(448): a, c, t, g, unknown or other
  modified_base (450)..(450): a, c, t, g, unknown or other
  modified_base (452)..(454): a, c, t, g, unknown or other
  modified_base (468)..(468): a, c, t, g, unknown or other
  modified_base (475)..(475): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagagtgtccagtgtcaggtgcaactggaggagtcgngggggaggcgtggtccagcctgggagtccctgagactctcctgtacngcctntggcttcaccttcattaccatggcatgcacgtgggtccnctagacctccaggcgagggggctggggagtggggtgctaggtttattcgaattangtaatagggaaaatcggtanactttactattcagtacttccgggagaaggggccaattccaccgtctccaganactaaagtcagcacngctnnnnananananancnannngagacgacgctgtntatatgngacgaatataatagtagtacgagtacggtacggtacgtg

SEQ ID NO: 410473 - DNA, 599 bp, Homo sapiens
  misc_feature: GZ8MTXP02GIU1W.11.71.G05.1.454.CMB.2.raw
  modified_base (306)..(306): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggagcgtggtccagcctgggagtccctgagactctcctgtacagcctctgcttcaccttcattacctatggcatgcacgtcgggccncagactccgaggccgagggggctgggagtggtggcagtttattcgatagtgaagtaggaatgtagtactttactatcagacctccgtagaaacgggcccgtattccgacccgtctccgaagtacgacaaacgttccaacggccaccaacgtctacgttacgtctaacgactaaaagtacgaaacacggacctaggacgtaacggctaggggaacggtacgaacgggtctacggttagttaacgttaaccgtaggtacgtaacggtaaaacgtctttaaccgtaagtaaacggg

SEQ ID NO: 410474 - DNA, 607 bp, Homo sapiens
  misc_feature: GZ8MTXP02G5XRG.11.71.G05.1.454.CMB.2.raw
  modified_base (303)..(303): a, c, t, g, unknown or other
  modified_base (337)..(337): a, c, t, g, unknown or other
  modified_base (350)..(350): a, c, t, g, unknown or other
  modified_base (474)..(474): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggagcgtggtccagccgtgggacgtccctgacgactcctcctgtacacgtcctcgtgtccttcaccttcattaccatcggcatcgcacgtcgggtacccncgagcctccggaggcggaggggctgggagtgggngtactagtttctnatagtgaagtagaacttgcgtacttactacgtcgacgtacgtccggtaaggaaccgtctattacccgaccgtctaccgagaactactaacgtaccgacggacaaccgagtactgtaaactctanactaagacacgacgtaccgtagacgagtcgaggacgacgacgtgtacgttagtacttagacggtaacgaacgtaaagttactttaagaacgtaagggtacggtacggtacgggttacgggttacgtttaacgg

SEQ ID NO: 410475 - DNA, 615 bp, Homo sapiens
  misc_feature: GZ8MTXP02FJYLO.11.71.G05.1.454.CMB.2.raw
  modified_base (269)..(269): a, c, t, g, unknown or other
  modified_base (315)..(315): a, c, t, g, unknown or other
  modified_base (372)..(372): a, c, t, g, unknown or other
  modified_base (387)..(387): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggacgtccctgagctctcctgtacagcctcnggtcttcaccttctattacctatcggcatgcctacgtcgggtcccnccgagacctccgagggcgagggggcttgggagtggggtgctagtttatttcattagngtagttaggtaatgngtacttctaattcagtaccgttcgtaggtaacggtcgtacttccgacccgtcctaccgagtaacgaacgtaaacttcccgaggcctaacgacggtcttacggttactctacggtaaacaaattaacgaaacgtaacgccgtagacgacgtacgtacggaaacggacgacggtacttaggtacgtttacgtaacgtgtacggacgtaaagtatttacgagttaaacggg

SEQ ID NO: 410476 - DNA, 646 bp, Homo sapiens
  misc_feature: GZ8MTXP02GYGL7.11.71.G05.1.454.CMB.2.raw
  modified_base (301)..(301): a, c, t, g, unknown or other
  modified_base (309)..(309): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggagtccctgagactctcctgtacagcctctggcttcaccctttcattaccctatcggactatcgcctacgtcgggcccnccagtccnccgaggcgagggggctggggaggtggggtggcttaggtttacttcaaagtagtggtaagtacgggaaaattcgggtattactttacttaattccgaagtacccggttccggacggggtaaagggggtcccctatttacccgtacccgtaccgtacccaacgacgaaacctaacttacccgacggaccaccgtacgtaccttagtactacgtacgtacaaaagttacgaacgtacgaccgtagacgagacgtaggacgacgacgtcgtagtagttacgtagtgtacgagtaacttagtaacgtagaggtacgtaggtacggtacggggtacgtttcgg

SEQ ID NO: 410477 - DNA, 635 bp, Homo sapiens
  misc_feature: GZ8MTXP02J09JT.11.71.G05.1.454.CMB.2.raw
  modified_base (184)..(184): a, c, t, g, unknown or other
  modified_base (277)..(277): a, c, t, g, unknown or other
  modified_base (355)..(355): a, c, t, g, unknown or other
  modified_base (488)..(488): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggtttttcctcgttgcttcttttaagnggtgtccagtgtcaggtgcaacgtggaggaggtcggtgggggaggcggtggtccaggcccgtggggacggtccctgacgtactctccgtgacngtcctcgtgtccttcaccttcacttacctatcgctagtcgacacgtcggtccccgccagtacctccggagggccgggnggggtctgggacggtggggtcgacttagttatttcattagtggaactagggtaatcggtattaccttgtactacgagccgtccgtaggacggcgtactcgaccctcgaccagactactacgtccgaggccacncgtctagattccgagaactaaagcgaaacctcggtaccgtgaagtaccggacgtcgggaaacggtacccgacggtaccgtggtttaacgttacgttccggttaggtaccggtaaagtaaaacgtttcttaaacgttacggaacgggg

SEQ ID NO: 410478 - DNA, 594 bp, Homo sapiens
  misc_feature: GZ8MTXP02JIW38.11.71.G05.1.454.CMB.2.raw
  modified_base (184)..(184): a, c, t, g, unknown or other
  modified_base (298)..(298): a, c, t, g, unknown or other
  modified_base (326)..(326): a, c, t, g, unknown or other
tcagcgagagataccacgaccggtgctcgatttagtgtcgtcgcaagagagaggggggagctctgggagaggagcccagcactagaagtcggcggtgtttccattcggtgatcagcactgaacacagaggactcaccatggagtttgggctgagcttgggttttcctcgttgcttcttttaagnggtgtccagtgtcaggtgcaactggaggagtcggtggggggaggcgttgggtccaggccgtgggggacggttccctggacacctctcctagtacacgcctctggcttcaccttnacttaccagtgctatgctacgtggtccncagtacctcgaggcgagggggtctggggaggtcgggtggactagtttacttacatatggatagggaatggtatacttcgtatcgaacgtccgtccgtaggaacggtcctacgttccaccgtcacctagacgaacacgttacacggtcacacgtactgtactactagaacaaagtacgaacacgctagagagtacgaggacgaacgtacggacttacgtagttactaagttaggacggtacgtaaagtttactttaacgtacgtaaggg

SEQ ID NO: 410479 - DNA, 663 bp, Homo sapiens
  misc_feature: GZ8MTXP02JECJM.11.71.G05.1.454.CMB.2.raw
  modified_base (245)..(245): a, c, t, g, unknown or other
  modified_base (290)..(290): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggagtccctgagactctctgtacngcctctggcttcaccttcattacctatggcatgcacgtgggtccnccagactccgaggcgaggggctggaggtgggtggcgtagtttagtttcatagtagagtaggaaaattgtagtactttactattcgagtaccgttccgaggaacgggcctattccaacccgtcgtacccagaacgactaacgttccacgggacaaccgacgtaccttaggttaactcgttagaacgtaaaacgtacgaaaccgacggtaccttaggaacgtacggaccgttagggaacggtaccgaacccgggtacgttcgggtttaagttaaccgtttacgtagggttacgtaaaccggttaaaacgttagtttaaccgtaaggttaaaggtacggggtacgttaaccggggtacgggggtaccgttttccgg

SEQ ID NO: 410480 - DNA, 711 bp, Homo sapiens
  misc_feature: GZ8MTXP02FHCLG.11.71.G05.1.454.CMB.2.raw
  modified_base (183)..(183): a, c, t, g, unknown or other
  modified_base (201)..(201): a, c, t, g, unknown or other
  modified_base (211)..(211): a, c, t, g, unknown or other
  modified_base (289)..(289): a, c, t, g, unknown or other
  modified_base (310)..(310): a, c, t, g, unknown or other
  modified_base (339)..(339): a, c, t, g, unknown or other
  modified_base (383)..(383): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgctcttttaaagnggtgtccagtgtcaggtncaactggagngtcgtgggggagcgtggtccagcctgggagtccctgagctctcctgacagcctcgtggccttcaccttcacttacctntggccatgcacgtgggtcccnccagcctccgagggccgaggggctagggngtggggtcggctagtttattcgattagtgattacgggaattcgngtactttactagttacgagtaccgtaccggtaggaaaccggggtcccgtaactttcccgaaaccccggttccctaccaaacggaacgtaacctaaaacgtttcccggaaacggtcccaaccgacccggtacctttcgggtaaacttccgttcggaaccctaaaagttaccggaaacctaacggccccgttaaagggtaaacggtaacggcccgttaaggggaaacgggaaacccgttaccggggtcgttacgggttaagtttacgttaaccgttgggtaaacggtaacccggtaaaagtttaacgttttaccaaagtttaaacggggg

SEQ ID NO: 410481 - DNA, 724 bp, Homo sapiens
  misc_feature: GZ8MTXP02GXUA5.11.71.G05.1.454.CMB.2.raw
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggagcggtggtccagccgtgggaggtccctgacgactctctgtacagcctcgtgccttcaccttcattaccatggcatgcacgtcgggtcccaccacgacctccggaggcgacgggggtctgggagggtcggggtgtacgtagtttacttacagttagtggagtaagggtaaaatgtagtactttctaattcgagtaccgtccggtaagaaccggggtcctaattccctaacccgtccgtacccgaagaaccgtaacgtaaacgttacccgaacgggtacctaacccgtaccgtaccgttacgtaacgttcccgttaagaactaaaacgtagtaaaccgtacggaccccgttaaggaacggtacgtaacgggttaacggaacgggtaaaccgccgggggttacttacggttagtttaccgttaacggtagggtttaaacgaacggggttaaaattacggtttaagtaaacggtaagggtacgggtaacggtaacgggtaccgggggtttaacgtttaccgg

SEQ ID NO: 410482 - DNA, 824 bp, Homo sapiens
  misc_feature: GZ8MTXP02GVNPB.11.71.G05.1.454.CMB.2.raw
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcggtgggggaggcggtggtccaggccgtggggacggtccctggacgtacctctcctgtacacgtcctcgtcgtcttccaccttctattaccctagtggcatcgactaccggtcggtaccccaaccgagacccgtaccggaaggggccggagggggtcgtggggtaggggttggggtcggtacgttaggtttttactttcgtaagttagttaggtaacgttaagggtaaaagtttacggtacgtttactttaccgttaacgtttaccgaaccggttaccggttacccgggtaaggggtaaccggggtacccgttacgttaccccgtaacccgttaccgtaccgaacggtaaacgtaacccgtaaccgttacccggaacgggtaccaacccgtacccgtacgtttacgttaaccgtacctaacggtaaacgtaaacggtaaccgtaaacggtaccgtaccgtaagggtaccggacggtacggaacggggaacggtaccggtacggtaccgtttgggttaacgttaacgtttacggtgttaaacggtaaaccgttaagtttacgttaacggttaaggtacggggtacgggttacggttaccgggggtttacgggtttacgtttaaccgg

SEQ ID NO: 410483 - DNA, 803 bp, Homo sapiens
  misc_feature: GZ8MTXP02I650N.11.71.G05.1.454.CMB.2.raw
  modified_base (302)..(302): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcgaggtgcaactgggaggagtcgtgggggaggcggtggtccaggccgtggggaggtccctgacgactctctgtacagcctctggccttcaccttcattaccagtcgcatgccacgtcgggtccnccgagcctccgaggcggagggggctggggtacggtggggtaggtcgtaaggtttactttacgattaggtagtaagtacggggtaaaaaattcggttaacgttacctttacgttaaacgtttacccgaacgggttaacccgttacccggggttaggggaaaaccgggggttaccccttaaaccgtttaccccggtaaacccccgtttacccgtaacccggtaaacggtaaaccggtaaacccgttaaaccgttaccccgaacgggtaacccaaaccgtaccggtaccttacggttactaccgttagaaaccctaaaagttacgaaaaccgtacggaacccgttaggaacggaacgtccggtaaggtaaccgggaaccgtaccggtcgttaggttacgtttaaacgttacgttaggttaacggtaaccgttaaagttacgtttaacgtaggtttaaggacgggttacggtaaccgggggtttacggggtacgttttaaccggg

SEQ ID NO: 410484 - DNA, 643 bp, Homo sapiens
  misc_feature: GZ8MTXP02G5RR1.11.71.G05.1.454.CMB.2.raw
  modified_base (252)..(252): a, c, t, g, unknown or other
  modified_base (295)..(295): a, c, t, g, unknown or other
  modified_base (558)..(558): a, c, t, g, unknown or other
  modified_base (571)..(571): a, c, t, g, unknown or other
  modified_base (603)..(603): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgttgggttttcctcgttgcttcttttaagaggtgtccagtgtcaggtgcaatgggagagtcgtgggggagcgtggtccaggccgtgggacggtccctgacgtactctcctgtacngcctctggcttcaccttcatacctatgcatgcacgtcgggccnctagctccgaggcggaggggtctgggtaggtggggtcggacgttaaggtttactttacgaattagtaggtaagtaaggtaaaacttggtagtaactttcctaagttccaacgggtaaaccctcggggttaaggaaacggggtccttacttacccgtacccggtctacccgaaaggtacaaacgtaacgttccgacggaccaacgctactagtactccgtagaacaatacgaacgacgaccgtagagtacgcgaggacggaacncggtcgtaggttntacgttacgagtacgaacgttaaatatttaanaaggtacggtagggacgtacggggtaacggtcctttacgg

SEQ ID NO: 410485 - DNA, 639 bp, Homo sapiens
  misc_feature: GZ8MTXP02FG503.11.71.G05.1.454.CMB.2.raw
  modified_base (262)..(262): a, c, t, g, unknown or other
  modified_base (303)..(303): a, c, t, g, unknown or other
  modified_base (368)..(368): a, c, t, g, unknown or other
tcagcgagagataccacgaccggtgctcgatttagtgtcgtcgcaagagagagggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggagagtcgtgggggagcgtggtccagccgtggggacgtccctgagactctcctgacagcctntggcttcaccttcattacctatggcatgcacgtgggtcccncagacctccgaggcgagggggctgggagtggggtggctagttattcatatgataggaaattggtntactttactatacgagtaccgtccgtaggaaacgggtcccgtattccgacccggttacctacccgagaacgtaccaacgttacccgaacgggtccaaccgaccgtactggtaactctacgactaaaagtcgaaaccgacgtcctagggaagacggtacgtgggaacggaccgacggtccttaggtacgttaacttaccgtaggtacgtaaccggtaaaaggttctttaacgtagtaacggtaggggtaccggtacgggtttaaccgggggg

SEQ ID NO: 410486 - DNA, 670 bp, Homo sapiens
  misc_feature: GZ8MTXP02GQC9K.11.71.G05.1.454.CMB.2.raw
  modified_base (231)..(231): a, c, t, g, unknown or other
  modified_base (297)..(297): a, c, t, g, unknown or other
  modified_base (376)..(376): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggagtcccngagactctctgtacagcctctgccttcaccttcacttaccctatcggcatcgcaccgtggggtccncagacctcgaggcgaggggctggaggtgggtggactagtttattcgatagtgaataggaaacttggtacgtaccttttntaattcgacgttaccgttaccggtaggaaaccgggggtcccttagtttacccgtacccgttacgtacccgaacggtacgtaacccgtaaacgtttacccgaaccgggtaccaacccgaccgtacttacgtacttcgttacgaactaaactacgaaccgacgtccgttagacgtagaccgtaggacggtaaacgacggtacgtcggttacgttaacgttacggtagtacggaacgtaaagttacgttaagtaacgtacggtaggtacggtaccgggtacgggggtacctttacgg

SEQ ID NO: 410487 - DNA, 592 bp, Homo sapiens
  misc_feature: GZ8MTXP02FS8VN.11.71.G05.1.454.CMB.2.raw
  modified_base (182)..(182): a, c, t, g, unknown or other
  modified_base (248)..(248): a, c, t, g, unknown or other
  modified_base (267)..(267): a, c, t, g, unknown or other
  modified_base (276)..(276): a, c, t, g, unknown or other
  modified_base (294)..(294): a, c, t, g, unknown or other
  modified_base (345)..(345): a, c, t, g, unknown or other
  modified_base (361)..(361): a, c, t, g, unknown or other
  modified_base (368)..(368): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcgtggttttcctcgttgctcttttaagaggtgtccagtgtcaggtncaactggaggagtcgtgggggagcgtggtccagccgtggggacggtccctgagactctcctgtacngcctctggtcttcaccttnattacctanggcatcgcacgtcggccncagactccgaggcgaggggctgggaggtgggtggctaagtttattcaagtntagatggaaaatggtntactttntaattcgagtaccgtcggtagaacgggcctattcccaccgtctaccgagtacgaactacttacacgacacgtacgtctagtactactagaactaataacgaacgacaccgtagagacgacgaggacgacgacggtacgtgtacgttacgttacgttacggtacgtacgtaagttaacttaacgttaagtacggtacggtaggtacggtaacgggtcgtttacgg

SEQ ID NO: 410488 - DNA, 610 bp, Homo sapiens
  misc_feature: GZ8MTXP02GLHVY.11.71.G05.1.454.CMB.2.raw
  modified_base (183)..(183): a, c, t, g, unknown or other
  modified_base (262)..(262): a, c, t, g, unknown or other
  modified_base (306)..(306): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagnggtgtccagtgtcaggtgcaactggaggagtcgtgggggagcgtggtccagcctgggagtccctgagctctcctgtacngcctctggctcaccttcattacctatcggcatgcacgtcggccncagactccgaggcgaggggctgggagtgggtggatacgtttattcaatatggatagggaactgtgtactttctattacagtacctccgtagaaacgggtccgtaactttccgaacccgttccgacccaaaggacgaactaaacgttccgaacggtaccaacgacggtcttaggtactcgtacgaacaaagtacggaaacacggcctaggaagaacgtcgaagggacgaaccgacggtcgttacggtactttaagtaaccgttggtaacgtaacggtaaaagttactttacgtaaagttaacggg

SEQ ID NO: 410489 - DNA, 623 bp, Homo sapiens
  misc_feature: GZ8MTXP02J2I6S.11.71.G05.1.454.CMB.2.raw
  modified_base (165)..(165): a, c, t, g, unknown or other
  modified_base (248)..(248): a, c, t, g, unknown or other
  modified_base (265)..(265): a, c, t, g, unknown or other
  modified_base (292)..(292): a, c, t, g, unknown or other
  modified_base (357)..(357): a, c, t, g, unknown or other
  modified_base (413)..(413): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagnggtgtccagtgtcaggtgcaactggaggagtcgtgggggagcgtggtccagccgtgggacggtccctgagactctcctgtacngcctgtgcttcaccttnattaccatggcatgctacgtcggtccnctagacctccgaggccgaggggctgggagtgggtgctagttattcagtatgataggaataggttnacttcgtaatttcgagttaacctccggtagaacggggtcctaattcccgacccgtntacccagtaacacgtaactccgaggaccacgacgctagtactctacgactaagtaagacctaacgcctagggaacgaacggccgtaggaaccgggtaccgacggttacgtcgttagtaccgttagttaccgtagtaaccgtaaaacgttgtttaacgtaacggttaggtaaccgggttaggtacccgggtaacgggggttctttaaccgg

SEQ ID NO: 410490 - DNA, 565 bp, Homo sapiens
  misc_feature: GZ8MTXP02I02NK.11.71.G05.1.454.CMB.2.raw
  modified_base (341)..(341): a, c, t, g, unknown or other
  modified_base (344)..(344): a, c, t, g, unknown or other
  modified_base (357)..(357): a, c, t, g, unknown or other
  modified_base (363)..(363): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccagccgtggggacgtccctgagacttctcctgtacagcctctggcttcaccttcattccatggcatcgcacgtgggcccacctagacctccgaggcgaggggctgggacgtgggtgctagtttcttnatntgagtgaaatgtntacttntatcgagtctcgagacgggctattccacgtctccagagaactataccgagcacgacactgtactctagactaagtacaactacgcgtaggacgagtcgagaacggacgaccggtatcggttaggttacttacgttacggtagtaacgtaagttatttaacgtagtaacggtaggtacgtaaccgggttacgggtcgtttacg

SEQ ID NO: 410491 - DNA, 650 bp, Homo sapiens
  misc_feature: GZ8MTXP02FHOYU.11.71.G05.1.454.CMB.2.raw
  modified_base (248)..(248): a, c, t, g, unknown or other
  modified_base (276)..(276): a, c, t, g, unknown or other
  modified_base (295)..(295): a, c, t, g, unknown or other
  modified_base (324)..(324): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagtctgggttttcctcgttgctcttttaagaggtgtccagtgtcaggtgcaacgtggaggagtcgtgggggaggcgtggtccagcctggggacgtccctgagactctcctgacngcctgtggcttcaccttcattaccctanggcatgcacgtcgggtccnccagacctccgaggcgagggggcttgggnggtgggtggctaggtttactttcattcgtagagtaaggtaaaactgttacgtacctttctaatttccaacggtacccgttcgtacgggaaacgggtccgtaaacttcccgtaacccgttcctacccgaagtaaacacgtaaaccgttccaacgggacaaccgacgtacgttcgttaactcgtagacctaaaagtacgtaaaccagcccgtagagacgagtacggaagacgaacggtcgttgttataacgttacgtcggtacgtacgtaaaacttagttaaccgagttaaggtacggtacggtacggtaaccgggggtctttaccgg

SEQ ID NO: 410492 - DNA, 570 bp, Homo sapiens
  misc_feature: GZ8MTXP02HQDY8.11.71.G05.1.454.CMB.2.raw
  modified_base (245)..(245): a, c, t, g, unknown or other
  modified_base (257)..(257): a, c, t, g, unknown or other
  modified_base (262)..(262): a, c, t, g, unknown or other
  modified_base (273)..(273): a, c, t, g, unknown or other
  modified_base (305)..(305): a, c, t, g, unknown or other
  modified_base (323)..(323): a, c, t, g, unknown or other
  modified_base (345)..(345): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggagagtcgtgggggagcgtggtccagccgtgggacgtcctgagactctctgtacngcctctgcttcnccttnattacatgacntgcacgtcggccacagcctcgaggcgaggggntgggagtggtgctagttntacatatgagtaggaaaatgtntacttctatcgagtactccgagtacgggcctatccaccgtctacagacactactccacggcacgacgtctagttatctacgaactaatacgaacagtccgagacgagcgtaggacgtacgacggtcgttaggtagtttaacgttagttacggtacgtaacgttaaagttagtttaactaaggtacggtagggtacggtaccgggttaacgggggttctttaccgg

SEQ ID NO: 410493 - DNA, 774 bp, Homo sapiens
  misc_feature: GZ8MTXP02JL80F.11.71.G05.1.454.CMB.2.raw
  modified_base (183)..(183): a, c, t, g, unknown or other
  modified_base (255)..(255): a, c, t, g, unknown or other
  modified_base (282)..(282): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtncaactggaggagtcggtgggggaggcgtggtccaggccgtggggacggtccctgacgtactcctcctgtacngcctgtcgcttcaccttcattacctangcagtagctacgtcgggtccaccgtacgaccctcgacggcggacggggggtctggggagggttggggtacggtacctaggtttttacttagtaagttagtagaaccgtaaggtaaattaggttcctaactttactaacgttttccaaacggtacggttacccgggttaagggaccgggggttacccctacggttacccgtaaccccggttaccttacccgaaacgggtaacgtaaacccgtaaccgtttacccgaacggtaccgtaaccggtacgtaccgttacggttaaactcgttaagaacctaaacgttacggaaacgtacgtaacccggttagaacgggacggtaccggaggtaaacggggaccgttaacccgggtgttacggtttagttaacgtttacgtacggggtagtaacggttaaacgttagttttaaacgaggttaaacggtagggttacggtaccggggttaacggggttcggtttaaccg

SEQ ID NO: 410494 - DNA, 633 bp, Homo sapiens
  misc_feature: GZ8MTXP02FI48N.11.71.G05.1.454.CMB.2.raw
  modified_base (251)..(251): a, c, t, g, unknown or other
  modified_base (264)..(264): a, c, t, g, unknown or other
  modified_base (296)..(296): a, c, t, g, unknown or other
  modified_base (360)..(360): a, c, t, g, unknown or other
  modified_base (367)..(367): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccaggcctgggacggtcctgagactctcctgtacagcctntggcttcaccttnattacctatggcatcggctacgtggggtcccncagacctccgaggccgaggggctggaggtgggtgctagtttactttcatgtgagtagaaatgtntacgttntattcagtacctcgggtagaaacggggtcctaacttccgtacccgtaccttaccgacgtaacgaactaaacgttacccgacggtacaaccgacgtacgttacgttactccgtacgtacgtaaaacgtacgaaaccgtagtacccgtaggaacgagtcgtacggacggtacgaacggtacgttaggtagtacttacgtagtacgtaacggaagttaccgttaagttacgtaacgtaggtacggtacggtacgggggtacgtttacgg

SEQ ID NO: 410495 - DNA, 626 bp, Homo sapiens
  misc_feature: GZ8MTXP02JCKTK.11.71.G05.1.454.CMB.2.raw
  modified_base (321)..(321): a, c, t, g, unknown or other
  modified_base (468)..(468): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggacggtcctgagactctcctgtacagcctctggtcttcaccttcattaccctatggcatgcacgtcgggtcccaccagacctccgaggccgagggggccngggagtggggtgctagtttattcattagtcgagtaggaaattgtagtacctttctattccgaagtaccgttcggtacgaagggggtcccctaattcccacccgttcctacccgagaacgtactaaacttccgacggacaaccgtacncctagtactacgttacgaactaaagtacgaaacgtacgaccgtaggaacgacgcgtaggaacggacgaccggtctaggttgtagttaactggtacgacgtaaattagtttaacgtaagtacggtacggttggtaacggttacgggggtccgtttacgg

SEQ ID NO: 410496 - DNA, 610 bp, Homo sapiens
  misc_feature: GZ8MTXP02IOJ1O.11.71.G05.1.454.CMB.2.raw
  modified_base (267)..(267): a, c, t, g, unknown or other
  modified_base (273)..(273): a, c, t, g, unknown or other
  modified_base (310)..(310): a, c, t, g, unknown or other
  modified_base (343)..(343): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggaggcgtggtccagccgtgggacgtccctgagactctcctgtacngcctcnggcttcaccttcacttaccatgcatgcacgtcggccncagacctcgaggcgaggggctgggaggtggggngctagtttattcgatagtgattagggaattgtgtactttctattacgaagtaccgtccgtaggaacggtccgtaacttccgacccgttctaccgaaacgacgaactaacgttaccgaacggaccaacgaccgtcgtacgttactccgttagaacctaaaagtacgaaacacggacccgtaggacgtacggacgtaggaacggaaccgacggtcgtagttagttacgttaacgtgtaggaactaaaggtactttaagtacgtaagggg

SEQ ID NO: 410497 - DNA, 578 bp, Homo sapiens
  misc_feature: GZ8MTXP02JLC3C.11.71.G05.1.454.CMB.2.raw
  modified_base (180)..(180): a, c, t, g, unknown or other
  modified_base (412)..(412): a, c, t, g, unknown or other
  modified_base (564)..(564): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctctttaagnggtgtccagtgtcaggtgcaactgggagagtcgtgggggagcgtggtccagcctgggagtccctgagactctcctgtacacgcctcgtcggcttccaccttctacgttacctagtggcctatcggctacgtcgggtcccacgagactccgaggcgaggggctggagtgggtgctagttattcatagtgtacgtagacgtagtgtacttctattcgagtctcgtgacggtcgnttcgaccgtctaccagacgtaactaacgttccgaacgtccaaccgtaccgtactgttaacgtcgtagactaaaatacggaaccaggtccaggacgaacgcgtacggacgacgtacggtcgtacggtatagttaacgagtacgagtaaacgtntttacgagttaagg

SEQ ID NO: 410498 - DNA, 561 bp, Homo sapiens
  misc_feature: GZ8MTXP02HXSAF.11.71.G05.1.454.CMB.2.raw
  modified_base (307)..(307): a, c, t, g, unknown or other
  modified_base (336)..(336): a, c, t, g, unknown or other
  modified_base (338)..(338): a, c, t, g, unknown or other
  modified_base (344)..(344): a, c, t, g, unknown or other
tcagcgagagataccacgaccggtgctcgatttagtgtcgtcgcaagagagagggggagctctgggagaggagcccagcactagaagtcggcggtgtttccattcggtgatcagcactgaacacagaggactcacatggagtttgggctgagctgggttttcctgttgctcttttaagaggtgtcagtgtcaggtgcaactggaggagtcgtgggggaggcgtggtccagcctggggaggtccctgagactctctgtacagcctctggacttcaaccttcattaccgatggcatgcacgttgggccnctagactccaggcaggggctggagtgggngnagtatntatatgagagatagtatactactatacagactacgtacgaggacgtactacgtaccgtactaccacgaacgaactactacgacgacacgacgtacgtatactacgtagacaaataacgaacaacgacgtagagacgacgtacgacggaacgacgtacgtacgttagttacgttaacgttacgtacgtaacgtaaaagtaacgtttacgttaactaag

SEQ ID NO: 410499 - DNA, 602 bp, Homo sapiens
  misc_feature: GZ8MTXP02JV1LY.11.71.G05.1.454.CMB.2.raw
  modified_base (377)..(377): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagttgggctgagctgggttttcctcgttgcttcttttaagaggtgtccagtgtcaggtgcaacgtggaggagtcgtgggggaggcgtggtcccaggcctggggacgtccctgacgactctccgtgtacagtcctgtggtccttacacctttcaattaccctatcggcaagtgcctacgtcggtcccaccagcctccgaggccgaggggctggaggtgggtcgtctagttattcaagtgtagatacggaaattgngtacttcattccgagtaccgtccggtaggaacggtccgtatcccgtaccgtactaccgagtaacgactaacgttaccgaggaccaacgaccgtctagtaactccgaagaactaaatacgaacgtacgaccgtagacgagtaccgaggacgcgacggtctagtgtacgttcgtagtagacgtaagtacttaagagtacggtaggtcgtacggtacgggctttacgg

SEQ ID NO: 410500 - DNA, 631 bp, Homo sapiens
  misc_feature: GZ8MTXP02F7HRW.11.71.G05.1.454.CMB.2.raw
  modified_base (251)..(251): a, c, t, g, unknown or other
  modified_base (303)..(303): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccaggccgtggggacggtccctgacgactctcctgtacngcctcgtggcttcaccttcacttacctatggctagtcgctacgtcgggcccncaggacctccgaggcgaggggtctgggaggtgggtgctagtttcttcaatgtacgtagtaggaaaattggtacgtactttcttattccgaagtccgtccggtaggaaccgggtccgtaatcctacccgtctaccgagaacgtacctaacgttccgacgtaccacgtaccgtacttacggttactcgtacgtaacgtaaagtacgaacgacgaccgtaggtagacgacggtaggaacgtacggtaacggtcgttagtagttacgttacgtgtacgtacgtaagttattaagtaagtacgtaggtacggtacggtacggggtctttacgg

SEQ ID NO: 410501 - DNA, 807 bp, Homo sapiens
  misc_feature: GZ8MTXP02FPOI2.11.71.G05.1.454.CMB.2.raw
  modified_base (796)..(796): a, c, t, g, unknown or other
tcagcgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcggtgggggagcgtcggtccaggccgtaggggacggtccctggacgaccttcctcctagtacagtcccttgtcggtccttacctaccctttctaacttacccgtaagtcggacctatccggacctacggttcggggtccccaacccgtaggtaacccgtccggaaggggtccggtaacggggggggccttagggggagggttcggggtacggtacgttaggttttaactgtaagttagtagtaaccgtaggtaaaatgtacgtactttatactttacgacgtaccgtcggaggtaacgggtacctagtacccgtacccgtcgttaaacccgagtaacgtaacccgttaaacgtcccggaacgggtacctaaacccggcgttaaccgttaacgttacgttacccgttaaggaaaccctaaaagggttaccctaaaacgggacccgtttaacctagggtaaacggacggttagaaccgggtaaggaccccggtaaggttccgttaaggttagttaaacgttaccgtagggttaaccaaaacggttaactttacgttaacgttaaggtaaggttacggtacgggtacgggtaccgggggttntttaaccgggg

SEQ ID NO: 410502 - DNA, 405 bp, Homo sapiens
  misc_feature: GZ8MTXP01DFHEG.44.45.E01.1.454.CMB.2.raw
  modified_base (400)..(405): a, c, t, g, unknown or other
tcagacagtatatacacgaccggtgctcgatttagtgagtcagtaagggaaagggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagccctccaccaagggcccatcggtctccccctggccgccctgcctccaggacgcacctccgagacgcacagcggccctgggctgcctggtcaaggcctactctatatactgtctgagcgggctggcaaggcgcatagnnnnnn

SEQ ID NO: 410503 - DNA, 474 bp, Homo sapiens
  misc_feature: GZ8MTXP01EAHY5.44.45.E01.1.454.CMB.2.raw
  modified_base (245)..(245): a, c, t, g, unknown or other
  modified_base (454)..(454): a, c, t, g, unknown or other
  modified_base (459)..(474): a, c, t, g, unknown or other
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctacgtggggccagggacnccctggtcaccgtctcctcacgccctccaccgaacgggcccagtccggtccttcccccgtggccgcccctgcctccgaggacgccacctccgagacgccacacggccggccccgtggggctgacccgttggtaccaaacgggtaccccttacctttcctaatacttacctcgttctgggacggccggggtactgggaccaagggccganagtgnnnnnnnnnnnnnnnn

SEQ ID NO: 410504 - DNA, 582 bp, Homo sapiens
  misc_feature: GZ8MTXP01EE2QV.44.45.E01.1.454.CMB.2.raw
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgctcttttaagaggtgtccagtgtcaggttcagctggtggagtcgtgggggagcgtggtccagcctgggactccctgagactctcctgtgttgcgtccgatcagtttcagtgactctgccatgcacgtgggtcccgccaggcctccgaggcgaagggggctgggagtggggtgcagtcatcgtggtctgatagggaaagtaaaaaagaattaactagtagggaaaaccttccggtagaacggggcctattcctccgtctccgagagactaaagttaccaagaaccaccgtagtactactaacaaagtagaaactaatttagagacgccgaggactcggtctctctattaattgacgacgccgtatcgttacgttacgttcggggccagggaacgcccgtggttacctccgttcgtcc

SEQ ID NO: 410505 - DNA, 580 bp, Homo sapiens
  misc_feature: GZ8MTXP01ET55H.44.45.E01.1.454.CMB.2.raw
  modified_base (296)..(296): a, c, t, g, unknown or other
  modified_base (365)..(365): a, c, t, g, unknown or other
  modified_base (407)..(407): a, c, t, g, unknown or other
tcagacagtatatacacgaccggtgctcgatttagtgagtcagtaagggaaaggggctgggagaggagcccagcaccagaagtcggcggtgtttccattcggtgatcagcactgaacacagaggactcaccatggagtttgggctgagctgggttttcctcgttgcttcttttaagaggtgtccagtgtcaggttcagctggtggagtcgtgggggagcgtggtccagcctgggacctcctgagctctctgtgtgcgtcggatcagttcagtgactctgccatgcacgtgggcccnccaggcctccgaggcaagggggctgggagtggggtgcagtcatcgtggtctgagtaggaaagtaaaaanataactatagggaaactcgtaggaacgggcctattctcgtcncagagactaactaccaagacaccgtgtaactactaacaaatagtaaactaagttagaagacgaccgaggaccgtcggtctcttactattaagttcgttacgacgttcctagttcgttcgttacggttcggggccctagggccgtcccggtaggttcctaacccgttcctcccg

SEQ ID NO: 410506 - DNA, 610 bp, Homo sapiens
  misc_feature: GZ8MTXP01B3NJU.44.45.E01.1.454.CMB.2.raw
  modified_base (177)..(177): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgcttcttttaagnggtgtccagtgtcaggttcagctggtggagtcgtgggggagcgtggtccagcctgggactccctgagctctctgtgtgcgtccgatcagttcagtgactctgccatgcacgtgggtcccgcaggcctccgaggcgaaggggctggagtgggtgcagtcatcgtggtctgagtaggaaagtaaaagaatctagtaggaaactcggagaacgggcctattctccgtctacagagaactaacttaccgaaagaacaccgtgtaactactaaacgaaatacgaaactaagtttaggacgtacgacccggaaggtacctcggtccttctacttaatttaagttcggttacgacgccctaacgttccggtttaccgttccggttcggggtcccgaagggggtccgtccccggtcgggttccctaacccggttctccccg

SEQ ID NO: 410507 - DNA, 643 bp, Homo sapiens
  misc_feature: GZ8MTXP01C8XUX.44.45.E01.1.454.CMB.2.raw
  modified_base (300)..(300): a, c, t, g, unknown or other
  modified_base (337)..(337): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcgtgggttttcctcgttgctcttttaagaggtgtccagtgtcaggttcagctggtggagtcgtgggggagcgtggtccagcctgggactccctgagactctcctgtgttgcgtccgatcagtttcagtgactctgccatgcacgtgggtccnccaggctccgaggcgaagggggctgggagttgggggngcagtcagtcgtggtctagagtaggaaagtaaaaaagaataacgtaagtaacgggaaacctccggtaggaacgggtcctattccgtaccgtcctaccgaagaacgaactaaacttaccgaaacgaacctaaccgtagtaactaactaaacaaagtacgtaaactaaagtttagaacgacgaccggaaggtaccgtcggtaccttcttacttaatttaagttacgttaacgtacgttacccgtaagttccgttacgttacggttacgggaacgagggccgtcccgtcggttaccgtccgttcctccg

SEQ ID NO: 410508 - DNA, 782 bp, Homo sapiens
  misc_feature: GZ8MTXP01DH4UP.44.45.E01.1.454.CMB.2.raw
  modified_base (299)..(299): a, c, t, g, unknown or other
  modified_base (333)..(333): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggactcctgagactctcctgtgttgcgtccgactcagttcagtgactctgccatgcacgtgggtcccnccaggcctccgaggcaagggggctgggagtgggnggcagtcatcgtggtctgatagggaaagtaaaaagaattaacgtaagtacgggaaaaccttcccggtaggaaacgggggtccctaagtttcccgtcccggtactacccgaaggaacgtaaaccgtaaaactttaccccgaaaagtaaacccgtaacccggttagtaaacttaaccgttaaaacctaaaaggttaacggtaaaaccttaaaagttttagggaaacggtaaccggacccggtaaacggggtaaaccgttcccggggtaccctttaccgttaaccctttaaagttttaaacgtttacgggttaaacccggtaaccggttaccccgttaaacgtttcccggttttacccgttaccgggttaccggggggaaccccgtaaacggggggtaacccgtcccccggttacggggttacccctaaccccgggttcccgttaacccccg

SEQ ID NO: 410509 - DNA, 591 bp, Homo sapiens
  misc_feature: GZ8MTXP01D0I8B.44.45.E01.1.454.CMB.2.raw
  modified_base (299)..(299): a, c, t, g, unknown or other
  modified_base (506)..(506): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggacgtccctgagactctcctgtgttgcgtccgactcagttcagtgactctgccatgcactgggtccnccaggctccgaggcaaggggctggagtgggtgcagtcatctggtctgagtggaaagtaaaaagaataacgtatacgggaaaacttccgtaggaacggggccgtaattcctccgtctaccgagagaactaacttacccaaagaaccaccgtagtaactactaacaaatagaaactaattagagagccgaagactcggtctctctattntgttacgacgttccctagttccgttacgttacggttcggggaacccgagggtaacgtcccgtggttacctaacccgttcctcccg

SEQ ID NO: 410510 - DNA, 544 bp, Homo sapiens
  misc_feature: GZ8MTXP01AGRO0.44.45.E01.1.454.CMB.2.raw
  modified_base (484)..(484): a, c, t, g, unknown or other
  modified_base (524)..(524): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggaggcgtggtccagcctgggaccgtccctgagactctcctgtgttgcgtccggactcagtttcagtgactctgccatgcactgggtcccgccaggctccgaggcaagggggctggagtgggtggcagtcatctggtctgatggaagtaaaagatctatggaaactcggtagaacgggcattctccgtctccagagacaactccaagaacaccgtgtaactctaacaaagtgaactaatttagagacgccgaggactcggtctctctattntgttacacgcccatcgttcgttacgttcggggccagggcncccgtggcctccgttctccc

SEQ ID NO: 410511 - DNA, 630 bp, Homo sapiens
  misc_feature: GZ8MTXP01CHB76.44.45.E01.1.454.CMB.2.raw
  modified_base (300)..(300): a, c, t, g, unknown or other
  modified_base (550)..(550): a, c, t, g, unknown or other
tcagacagtatatacacgaccggtgctcgatttagtgagtcagtaagggaaaggggctgggagaggagcccagcactagaagtcggcggtgtttccattcggtgatcatcactgaacacagaggactcaccatggagtttgggctgagctgggttttcctcgttgccctcttaagaggtgtcatgtgtcaggtgcaattcgtggagtctgggggagcgtggccccaggtagggggtccctgagactctcctgtgcagcctctggattcaccttcgataattggaatatgcagtgggtccnccaggctccgaggcgaggggctgggagtggggtggcgaggtgtgtctatttccgagttgggaaggtaaatcgaaaaaggttctaacgggtgtaacgtttcccgggttggacggggtcccgtaatttcccgaccctactcctacccagaacgaactaaacgttacccgaagtaaccacagtcgtacttcttacaaattacgaaacagcctagacgacctacgacggacgacggtccgttgttaagttttgnggtacgaggtaccttattcgttcgtttacctaaagttccggttaactacgttccgacggtcccgttcggggtaaccccgg

SEQ ID NO: 410512 - DNA, 587 bp, Homo sapiens
  misc_feature: GZ8MTXP01A0OW4.44.45.E01.1.454.CMB.2.raw
  modified_base (299)..(299): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgcttcttttaagaggtgtccagtgtcaggttcagctggtggagtcgtgggggagcgtggtccagcctgggacgtcctgagctctcctgtgttgcgtccgactcagttcagtgactctgccatgcacgtgggtccnccaggcctcgaggcgaagggggctgggagtggggtgcagtcagtcgtggtctggagtaggaaagtaaaagaactaactagtaggaaactcgtaggaacgggcctattcctccgtctccgagagacaaactccaaagacaccgtgtatactaacaaagtgaaactaattgaagacgccgaggactcggctctctattaatcgttacgacgccctaagttccgttcgttcggttcgggggaacctaacgggggcgtccccggtggttaccctaacccggttctaaccccg

SEQ ID NO: 410513 - DNA, 581 bp, Homo sapiens
  misc_feature: GZ8MTXP01B0W1U.44.45.E01.1.454.CMB.2.raw
  modified_base (299)..(299): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgcttcttttaagaggtgtccagtgtcaggttcagctggtggagtcgtgggggagcgtggtccagcctgggactcctgagctctcctgtgttgcgtcgactcagtttcagtgactctgccatgcacgtgggtcccnccaggctccaggcaagggggctggagtgggtggcagtcatctggtctgatggaataaaagaataactatagggaaactccgtaggaacgggccgattctccgtctaccagacgacaacttaccaaacgtaaccaccgttagtaatactaacaaagtacgaaactaatttagaagagccgaggacctcggtctcgtcttattaattgttacgacgccctagttcgttcttacggttcggggaaccacggggaacgtcccgtggttcctaaccggttcctcccg

SEQ ID NO: 410514 - DNA, 635 bp, Homo sapiens
  misc_feature: GZ8MTXP01BOQD9.44.45.E01.1.454.CMB.2.raw
  modified_base (300)..(300): a, c, t, g, unknown or other
  modified_base (351)..(351): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggacgtcctgagctctcctgtgttgcgtcctgactcagttcagtgactctgccatgcacgtgggtcccnccaggctccgaggcgaagggggctgggagtgggtgcagtcatccgtggtcngataggaaaataaagaatactagtagggaaacctccggtaggaaacgggtcccgtattctccgtctccgagacgaactaacttaccaagaacaccgtgtaactactaacgaaattgaaactaagtttagaagacgtaccggaggtaccgtcgggtaccttcttactaatttacgttcggtaacgacggtacccctaagtttccggtttcgttaaccgggttcgggggacccgtaacgggggtaccgtccccggttcgggttaacccgttaacccggtttccccg

SEQ ID NO: 410515 - DNA, 583 bp, Homo sapiens
  misc_feature: GZ8MTXP01EL6YJ.44.45.E01.1.454.CMB.2.raw
  modified_base (303)..(303): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcgtgggttttcctcgttgctcttttaagaggtgtccagtgtcaggttcagctggtggagtcgtgggggaggcgtggtccagccgtgggactccctgagctctcctgtgttgccgtccgactcagtttcagtgactctgccatgcacgtgggcccnccaggctccgaggcgaagggggctggagtgggtggcagtcatcgtggtactgagtaggaaacgtaaaagattaactagtaggaaacctcggtaggaacggggcctattcctccgtctccagacgactaattacccaaagaacaccgtatactactaacaaagtgaaactaattgagacgccgagactcggtctctactattaattcgttaacgcgttaccctagttccgttacgttcggttcggggcctaggggaactcccgtggcctcccgttctcccg

SEQ ID NO: 410516 - DNA, 613 bp, Homo sapiens
  misc_feature: GZ8MTXP01B3D9O.44.45.E01.1.454.CMB.2.raw
  modified_base (303)..(303): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggacgtccctgagactctcctgtgttgcgtccggactcagtttcagtgactctgccatgcacgtgggtcccnccaggcctccgaggcgaagggggctgggagtggggtggcagtcatcgtggtctgagtggaaagttaaaaagattaactatagggaaactccggtaggaacggggcctattccgtccgtctaccgagacgactaaacttaccaagaacaccgtagtaactctaaacaaagtgaaactaaagtttagaacgtagaccgaggaaccgtcggacttctacttaagttaattcgttaccgacttcccgtaatccgttcgttacgttcgggggaacccagggggtaactcccgtgggttcctaacccgttctcccg

SEQ ID NO: 410517 - DNA, 592 bp, Homo sapiens
  misc_feature: GZ8MTXP01EUPG1.44.45.E01.1.454.CMB.2.raw
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcgtgggttttcctcgttgctcttttaagaggtgtccagtgtcaggttcagctggtggagtcgtgggggaggcgtggtccagccgtgggactcctgagctctctgtgtgcgtccgactcagttcagtgactctgccatcgcacgtcgggtcccgccaggcctccgaggcgaagggggtctgggaggtgggtgcagtcagtctggtctaggagtagggaaagtaaaaagaataactagtacgggaaacttccggtaggaacggggcctattcctccgtctccgagacgactaactaccaaagaacaccgtatactactaacaaatagaaactaagttagagacgaccgaggactcgtctacctctatttaacgtgttacgacgttcctattcgttacgttacgttcggggcgagggcgtcccgtcggttcctaacccgttctcccg

SEQ ID NO: 410518 - DNA, 601 bp, Homo sapiens
  misc_feature: GZ8MTXP01C8ZVS.44.45.E01.1.454.CMB.2.raw
  modified_base (328)..(328): a, c, t, g, unknown or other
  modified_base (417)..(417): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggacgtccctgagactctcctgtgttgcgtccggactcagtttcagtgactctgccatgcactgggtccgccaggctcaggcaagggctggagtggngcagtcatcgtggtctgataggaaagtaaaaaagaataactaatcgggaaaacttccggtagaaacggggccattactcgtctacaganaacgaattaccaaagaacaccgtagtaatactaacaaatacgaaactaaatttagaagtacgcgaggtaacgtcggtctactctaatttaagttacgttacgtacgaccctaatcgtttacgttccgttacggggcccgaaggggtaacgtccccgtcgggttccctaacccggttccgtcccg

SEQ ID NO: 410519 - DNA, 601 bp, Homo sapiens
  misc_feature: GZ8MTXP01DIW4K.44.45.E01.1.454.CMB.2.raw
  modified_base (161)..(161): a, c, t, g, unknown or other
  modified_base (276)..(276): a, c, t, g, unknown or other
  modified_base (299)..(299): a, c, t, g, unknown or other
  modified_base (422)..(422): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcgtgggttttccncgttagcttctttaagaggtgtccagtgtcaggttcagctggtggagtcgtgggggagcgtggtccagcctgggactcctgagctctcctgtgttgcgtccgactcagttcagtnactctgccatgcacgtcgggccnccgaggcctccgagggcgaagggggtctggggaggttggggtggctagtcatcgtggtctgagtaggaaagtaaaagaataacgataggaaactcgaggaacgggctatctcgtctaccaganacaataccaaagtaaccacgtagtaactactaacaaatacgaaactaattagaagacgccgaggtaccgtcgtctctcttaattaagttacgttacggtacacccgttacttccggttcgttacggttacggggccgaacgggtccgtcccgtcgggttccctaacccgttccgtcccg

SEQ ID NO: 410520 - DNA, 561 bp, Homo sapiens
  misc_feature: GZ8MTXP01A3XB4.44.45.E01.1.454.CMB.2.raw
  modified_base (301)..(301): a, c, t, g, unknown or other
  modified_base (398)..(398): a, c, t, g, unknown or other
  modified_base (489)..(489): a, c, t, g, unknown or other
  modified_base (494)..(494): a, c, t, g, unknown or other
  modified_base (540)..(540): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcgtgggttttcctcgttgctcttttaagaggtgtccagtgtcaggttcagctggtggagtcgtgggggagcgtggtccagccgtgggactccctgagactctctgtgttgcgtcggactcagttcagtgactctgccatgcacgtgggtcccncaggcctccgaggcgaagggggctggagtgggtgcagtcatctggtctagagtaggaaagtaaaagatcagtaggaaactcgtagacgggcattccncgtctacagacgaactaacttccaaagtaaccaccgtataactactaaacaaagtgaaactaagttacgaagacgccgagacctcggtctntactnttaatgttacacgccctattcgttcgacggttcggggccagggccnccgtggacctccgttcgtccc

SEQ ID NO: 410521 - DNA, 604 bp, Homo sapiens
  misc_feature: GZ8MTXP01D8HTQ.44.45.E01.1.454.CMB.2.raw
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggacgtccctgagactctcctgtgtgcgtcggactcagttcagtgactctgccatgcacgtgggtccgccaggctccgaggcgaagggggctgggagtgggtgcagtcatcgtggtctagagtggaaagtaaaagaattctagtacgggaaaacctccggtagaacggggccgtattccgtaccgtctccgagacgaactaacttacccaaagaaccaccgtagtaatacctaacaaagttagaaactaattacggaagacgaccgagtaacgtcgcttctctattaacttgacgcgttccctagttccgttacgttcggttacggggcccgtaaggggccgtcccgtcgggttcctaaccgttccgttcccg

SEQ ID NO: 410522 - DNA, 694 bp, Homo sapiens
  misc_feature: GZ8MTXP01E0CXN.44.45.E01.1.454.CMB.2.raw
  modified_base (300)..(300): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgcttcttttaagaggtgtccagtgtcaggttcagctggtggagtcgtgggggagcgtggtccagcctgggactccctgagctctctgtgttgcgtccgatcagttcagtgactctgccatcgcacgtcgggtcccncgaggctccgaggccgaagggggctgggaggtggggtggctagtcagtcgtcggtctagagtaggaaaagtaaaaagaattaacgtagtaacgggaaaccttccgggtaggaacggggtccttattcccgtccgtctacgagaacaactaactaccaaacgacctacgtagtaactactaaacaaagtacgtaaacttaagttaggaacggtacgaccggtaacggtaaccgtcggtccttaccgttactttaagtttaacgtttacgttaaccggaacccgttacccgttaacgtttcccggtttaccgttccgggttccgggggtaacccggtacggggtaacccgtccccggttacgggttaccccttaacccggttccccgttaaccccg

SEQ ID NO: 410523 - DNA, 605 bp, Homo sapiens
  misc_feature: GZ8MTXP01A4BAH.44.45.E01.1.454.CMB.2.raw
  modified_base (302)..(302): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggaccgtccctgagctctcctgtgttgcgtcgactcagtttcagtgactctgccatgcacgtcgggtcccncaggcctccgaggcgaagggggctgggagtcgggtggacagtcatcgtggtctgatggaaataaaacgatcagtacgaaactcggagaacgggcctatctccgtctaccagaacgacaacttaccaaacgaacctaccgtagtaactactaaacaaatacgaaataatttagagacgccgtaggactcggtctactcttaagtttaacttgttacgtacgttcccgtaattccgtttacgttacggttcggggaaccgtacggggcgtccccggttcggttaccgtcccggttccgttccccg

SEQ ID NO: 410524 - DNA, 616 bp, Homo sapiens
  misc_feature: GZ8MTXP01AEPKF.44.45.E01.1.454.CMB.2.raw
  modified_base (300)..(300): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagccgtgggactccctgagactctcctgtgttgcgtcgactcagtttcagtgactctgccatgcacgtgggtccnccaggcctccgaggcgaagggggctgggagtggggtgcagtcatcgtggctgataggaataaaagataactagtaggaaactcggtaggaacgggcctattcctccgtctaccgaagaacgactaaacttacccgaaaagtaacctaccgttagtaactactaaacaaagttagaaacttaagttagaagacgaccgaggtactcggtctacgtacttattaagttcgttacgaccgttccctagttccgttcgttacggttccggggaaccaggggtccgtccccgtcggttaccctaacccggttccgtccccg

SEQ ID NO: 410525 - DNA, 608 bp, Homo sapiens
  misc_feature: GZ8MTXP01D321K.44.45.E01.1.454.CMB.2.raw
  modified_base (273)..(273): a, c, t, g, unknown or other
  modified_base (298)..(298): a, c, t, g, unknown or other
  modified_base (330)..(330): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagctggtggagtcgtgggggagcgtggtccagcctgggactcctgagctctctgtgtgcgtcgactcagttcagtnactctgccatgccacgtgggtcccncaggcctcgaggcgaagggggctggagtgggngcagtcagtctggtctagagtaggaaacgtaaaaaagactctaagtaagggaaaaccttccggtagggaaacgggggtcctaacttcgtcccgtactaccgagaacgaactaaacttaccaaacgaaccacgtacgtaactactaacaaatagaaactaattagagacgcgaggaactcggtctactctattaattagttacgacgttcctagttccgttacgttcgttcggggtaacccagggaaccgtcccgtcggttcctaaccgttcgttcccc

SEQ ID NO: 410526 - DNA, 643 bp, Homo sapiens
  misc_feature: GZ8MTXP01CFN2R.44.45.E01.1.454.CMB.2.raw
  modified_base (304)..(304): a, c, t, g, unknown or other
  modified_base (339)..(339): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagctggtggagtcgtgggggagcgtggtccagccgtgggacctcctgagctctcctgtgttgcgtccgatcagttcagtgactctgccatcgccacgtcgggtcccnccaggcctccgaggcgaagggggctggaggtgggngcagtcagtcgtggtctagagtaggaaagtaaaaagaattaacgtagtacgggaaaaccttccggtaggaaacggggtcctaagttcccgtcccgtactaccgaagacgtaactaaacgttacccaaagaacctaccgttagtaactactaacaaagtacgtaaactaagtttagaagtacgaccggaggtacctcggtctcgttacttagttaacttcgttacgtaacgcccgtaattcgttaccgttacggttcggggtcccacggggtccgtcccgtcgttcccgtaacccgttcctcccg

SEQ ID NO: 410527 - DNA, 684 bp, Homo sapiens
  misc_feature: GZ8MTXP01EV74U.44.45.E01.1.454.CMB.2.raw
  modified_base (299)..(299): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagttgggctgagcttgggttttcctcgttgcttcttttaagaggtgtccagtgtcaggttcagctggtggagtcgtgggggagcgtggtccagccgtgggactcctgagctctcctgtgtgcgtccgatcagttcagtgactctgccatcgcacgtgggtcccncaggcctcgaggcgaagggggctgggagtgggtcgcagtcatcgtggtctggaagtaggaaagtaaaaagataacgtaagtacgggaaacctcggaaggaaacggggactacttccgtccgtctaccgaagaacgaactaaacttaccgaaagaaccgtaccgtagtaaacttactaaacaaaggttaacgaaaacttaagtttaggaaaggacggacccggaacggtaaccgtcggtaccttcgttacttaaagtttaacttacggttaaacccgtacgttaccccgtaagttcccggttaccgttaccgggttccgggggaaccgtacgggggtaacccgtaccccggttcgggttaccctaaccccggtttccctaaccccg

SEQ ID NO: 410528 - DNA, 416 bp, Homo sapiens
  misc_feature: GZ8MTXP01EWHTL.44.45.E01.1.454.CMB.2.raw
  modified_base (303)..(303): a, c, t, g, unknown or other
  modified_base (321)..(321): a, c, t, g, unknown or other
  modified_base (338)..(338): a, c, t, g, unknown or other
  modified_base (411)..(416): a, c, t, g, unknown or other
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctacgtggggccagggacgccctggtcacccgtctcctcacgccctccaccaagggccccatccggtccttcccccnggccgccctgctccaggngcacctcgagagcacgngccggcccctggggctgcctggcaaggccctacttcatatacgtgtctgagcgggctggcaagggcacatagnnnnnn

SEQ ID NO: 410529 - DNA, 602 bp, Homo sapiens
  misc_feature: GZ8MTXP01AB8IJ.44.45.E01.1.454.CMB.2.raw
  modified_base (298)..(298): a, c, t, g, unknown or other
  modified_base (547)..(547): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgcttcttttaagaggtgtccagtgtcaggttcagctggtggagtcgtgggggagcgtggtccagcctgggactcctgagactctctgtgttgcgtcggatctagtttcagtgactctgccatgcacgtgggccnccgaggcctccgaggcaagggggctgggagtggggtggctagtcagtcgtggtctaggaagtagggaaagttaaaagaattaaccgtaagtacgggtaaaactccgggtaaggaacggggtcctattccgtccgtactaccgagacgtaactaacttaccaaagtaaccgaccgttagtaactactaaacaaagtacgaaactaagttagagacgcgagtactcggtctctactattaagtgttacgcnccgtattccgttcgttcgttgggcccgagggcctcccgtagcctccgttctcccg

SEQ ID NO: 410530 - DNA, 575 bp, Homo sapiens
  misc_feature: GZ8MTXP01C06M4.44.45.E01.1.454.CMB.2.raw
  modified_base (303)..(303): a, c, t, g, unknown or other
  modified_base (463)..(463): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttctttttaagaggtgtccagtgtcaggttcagctggtggagtcgtgggggagcgtggtccagcctgggacctccctgagactctcctgtgtgcgtccgactcagtttcagtgactctgccatgcacgtgggtccnccaggcctccgaggcaaggggctgggagtgggtgcagtcatcgtggtctgataggaataaaaagataactagtcggaaaactccggtagaacgggctattcctccgtctccgagacgaacaattaccaaagtaaccaccgtagaatactaaacaaagtanaaactaaattgaagtagccgagactcgtctctctattaatgttacgtacgccctaatcgttacgttacgttcggggccagggaacgtccctggttccctaaccgttctcccg

SEQ ID NO: 410531 - DNA, 558 bp, Homo sapiens
  misc_feature: GZ8MTXP01D7FDE.44.45.E01.1.454.CMB.2.raw
  modified_base (277)..(277): a, c, t, g, unknown or other
  modified_base (300)..(300): a, c, t, g, unknown or other
  modified_base (507)..(507): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagctggtggagtcgtgggggagcgtggtccagcctgggactccctgagctctcctgtgttgccgtccgatcagttcagtnactctgccatgcacgtggtcccncaggcctccgaggcgaaggggctgggaggtgggtgcagtcagtcgtggtctagagtaggaaagtaaaagaataacgtagtacggaaacctcggtaggaacgggtctattcctcgtctcgagagacaacttaccaaacgacacgtagtactactaacaaagtagaactaattagagacgcgagactcgtctctctattaattgacgcnccgtatcgttcgttcgttcgggcgagggcgccgtggttcctccgttcgtcc

SEQ ID NO: 410532 - DNA, 655 bp, Homo sapiens
  misc_feature: GZ8MTXP01AY8TU.44.45.E01.1.454.CMB.2.raw
  modified_base (301)..(301): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagccgtgggacgtccctgagactctcctgtgtgcgtccgactcagttcagtgactctgccatgcacgtgggtcccnccaggcctccgaggcgaagggggctgggagtgggtgcagtcagtcgtggtctgagtagggaaagtaaaaagaattaacgtagtacgggaaaaccttccggtaggaaacggggtccctaatttccctccgtctaccgaagacgaactaaacttacccaaagtaaccaaccgttagtaactactaaacaaagtagtaaactaagtttaggaagtacgaccgaggtacctcggtaccttcgttacttattaattcgttaacgtacgaccccgtaagttccgttaccgttcggttccgggggaacctacgggggtaaccgtccccggttagggttcccctaacccggttccgtccccg

SEQ ID NO: 410533 - DNA, 593 bp, Homo sapiens
  misc_feature: GZ8MTXP01AHU48.44.45.E01.1.454.CMB.2.raw
  modified_base (266)..(266): a, c, t, g, unknown or other
  modified_base (271)..(271): a, c, t, g, unknown or other
  modified_base (280)..(280): a, c, t, g, unknown or other
  modified_base (282)..(282): a, c, t, g, unknown or other
  modified_base (311)..(311): a, c, t, g, unknown or other
  modified_base (316)..(316): a, c, t, g, unknown or other
  modified_base (322)..(322): a, c, t, g, unknown or other
  modified_base (324)..(324): a, c, t, g, unknown or other
  modified_base (326)..(326): a, c, t, g, unknown or other
  modified_base (330)..(330): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcgtggtttcgcgttaggctctttaagaggtgtccagtgtcaggttcagctggtggagtcgtgggggaggcgtggtcgagcgtggacgtcctgagactctcctgtgtgcgtccggctcngttcngtgctctcncntgcgcgtcggccgcgcgcgcgcgcgaggngtggnggtggngngngtcngtgtcgtgtagtagtaaggtaagtaaaagtaataagtagtacgtaacgtacgtacggacggtacgtacgtctcgtacgtacgacgacgaactacgtacgaacgtaacgacgtacgtactactaactaacgtaacgtaaacgtaagtacgagacgacgacgtacgtcgtctactacttattaagtacgttacgtacgttaccgtacgttcgttacgttcggttcggaacggacggtcggtccgtcgttccgtccgttccgtccg

SEQ ID NO: 410534 - DNA, 623 bp, Homo sapiens
  misc_feature: GZ8MTXP01BHT3I.44.45.E01.1.454.CMB.2.raw
  modified_base (238)..(238): a, c, t, g, unknown or other
  modified_base (277)..(277): a, c, t, g, unknown or other
  modified_base (281)..(281): a, c, t, g, unknown or other
tcagacagtatatacacgaccggtgctcgatttagtgagtcagtaagggaaagggctgggagaggagcccagcactagaagtcggcggtgtttccattcggtgatcagcactgaacacagaggactcaccatggagtttgggctgagcgtggtttcgcgtagctctttaagaggtgtcagtgtcaggttcagctggtggagtgtggggagcgtggtccagccgtgggacgtcctgacnctctctgtgttgcgtcgatcagttcagtgactctgccancgcncgtcgtcgcgcgcgcgacgacgacggcggtggtaggtggtcggcgtagtcgtgtcgtcgtcgtagtagtagtaagtaaaagtaagtaacgtaagtaacgtaacgtacgtacggtacggtacgtacgtacgtccgtacgtacgacgaacgaacgtaacgtaacgtaacgtaacgtacgtacgtaactaactaaactaaacgtaacgtaagtaagtacgtacgacgacggacgtacgtacgtcgtacttacgttattaacgttacgttacgtacgttaccgtacgttcgttacgttcgttacggtaacggtacggtccgtcgtcgttaccgtccgttccgtccg

SEQ ID NO: 410535 - DNA, 580 bp, Homo sapiens
  misc_feature: GZ8MTXP01CLJ7F.44.45.E01.1.454.CMB.2.raw
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttggggttttcctcgttgcttcttttaagaggtgtccagtgtcaggttcagctggtggagtcgtgggggagcgtggtccagcctgggactcctgagctctcctgtgttgcgtccggactcagttcagtgactctgccatgcacgtcgggtcccgccaggcctccgaggcgaagggggctgggaggtgggtggcagtcatcgtggtctagagtggaaagtaaaagaataactagtaggaaactcgtagacggggcctattctcgtctcagacgacaacttacaaagaacaccgtagtatactaacaaagtagaaactaagtttagagacgcgaggactcggctctctattaattcgacgtacgcccgtaatcgttacgttacgttcgggggaaccgagggccgtcccgtcggttcctaacccgttctccccg

SEQ ID NO: 410536 - DNA, 626 bp, Homo sapiens
  misc_feature: GZ8MTXP01CLG3K.44.45.E01.1.454.CMB.2.raw
  modified_base (303)..(303): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagctggtggagtcgtgggggagcgtggtccagcctgggacgtccctgagctctctgtgtgccgtcgactcagttcagtgacctctgccatcgcacgtcgggtcccnccgaggcctccgagggacgaagggggcgtgggaggtggggtggcagtcagttcgtggtctaggagtaggaaagtaaaaagaattaacgtagtacggaaacctcggtagaacgggtctattccgtccgtctaccgagtacgaactaacttacccaaagaaccacgttagtaatactaacaaagtcgaaactattagagtacgccgaggtacctcggtctacgttcttaattaagtcggttaaccgtacgacccgttagtccggtttacgttcggcggggtaaccacggggtccgtcccggtcggttaccctccggttcctcccg

SEQ ID NO: 410537 - DNA, 673 bp, Homo sapiens
  misc_feature: GZ8MTXP01DVH4E.44.45.E01.1.454.CMB.2.raw
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagagtgtccagtgtcaggttcagctggtggagtcgtgggggagcgtggtccagcctgggactccctgagctctcctgtgtgccgtccgactctagttcagtgactctcgccagtcgcctacggtcgggtcccaccgacggtcctaccggagggtaccggaagggggtctagggggacgggtttggggcggacgtagtcgagttccggtggtctaggtagtaagggaaagttaaaaaagtaattaacgtaagtacgggaaaacccgttccggtaaggaacgggtcctattcccgtccgtacctacgagacaaactaaacttaccgaaacgtaaccacgttatactaactaactaaagtaacgtaacttaagttaggaacgacgacggagtaacctcgtcttactacttattaacgttcgaccgtacgttaccctaagttccgttacgttcggacggggtccaacggggcctcccggtcggacctaacccgttctaaccccg

SEQ ID NO: 410538 - DNA, 595 bp, Homo sapiens
  misc_feature: GZ8MTXP01E2JRL.44.45.E01.1.454.CMB.2.raw
  modified_base (296)..(296): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggccagcctgggactccctgagactctctgtgttgcgtccgatcagttcagtgactctgccatgcactcgggtccnccaggcctccgaggcaaggggctggagtgggtgcagtcatcgtgtctgagtaggaaagttaaaaaagattaacgtaatagggtaaaacctccggtaggaaacggggccctaaattcccgtccgtcctaccgagaagacctaaattcccaaagaaccaccgtagtaactactaacaaaagtgaaactaattagagtacgccgaggactcggtctactcttattaacttgttacggacttccccgaattcgttcgttacgttcggggcccagggcgccccgtggttccaaccgttctcccg

SEQ ID NO: 410539 - DNA, 731 bp, Homo sapiens
  misc_feature: GZ8MTXP01AGES5.44.45.E01.1.454.CMB.2.raw
  modified_base (215)..(215): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagtcgttgggttttccctcgttgcttcttttaagaggtgtccagtgtcaggttcagctggtggagtcgngggggaggcgtggtccagccgtgggaccgtccctgagctctcctgtgtgcgtccgactcagttcagtgactctgccatcgccacgtcgggtcccgccgaggcctccgagggcgaagggggtctgggagggtggggtggctagtccagttcgtggtctagagtaaggaaataaaaagataacgtagtacgggaaactccggtaaggaacgggtactacttcctccgtcctaccgaagacgtaactaacttaccaaacgtaaccgaccgttagtaactacgtaaactaaagtacgtaaactaagttacggaacgtacggaccgtaacggtaccgtccggtcttacctttacttaacgtttaacgttaacgggttaaccgtaacccggttaccccgttaacgtttacccggtttaccggttaaacccgggttccgggggtaaccccgggtaaccgggggaaccggttacccccgggttaccgggttcccccgttaaccccggtttccccgttaaccccg

SEQ ID NO: 410540 - DNA, 639 bp, Homo sapiens
  misc_feature: GZ8MTXP01DLGTT.44.45.E01.1.454.CMB.2.raw
  modified_base (296)..(296): a, c, t, g, unknown or other
  modified_base (329)..(329): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttggctgagctgggttttcctcgttgctcttttaagaggtgtccagtgtcaggttcagctggtggagtcgtgggggagcgtggtccagcctgggactcctgagctctctgtgttgcgtccgatcagtttcagtgactctgccatgcacgtgggtcccncaggcctcgaggcaagggggctgggagtggggngcagtcatctggtctgatggaaagtaaaagataacgtatacgggaaactccggtagaacgggtcctattctcgtctaccagacacaaattaccaaagtaaccaccgtagtaactactaacaaagtacgtaaactaagtttagaagtacggaccgacgggtaacctcggtcttaccgtacttaatttaagtttcggttaacgtaccgttccccgtaagtttcccggtttacccgttcgggttaccgggggtaacccgacgggggtaacgtcccccggttgggttaccctaaccccggtttccgttcccccg

SEQ ID NO: 410541 - DNA, 686 bp, Homo sapiens
  misc_feature: GZ8MTXP01BXUY8.44.45.E01.1.454.CMB.2.raw
  modified_base (307)..(307): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagctggtggagtcgtgggggagcgtggtccagccgtgggacgtccctgagctctcctgtgttgcgtccggactcagtttcagtcgactctgccatcgcacgtgggtcccnccaggcctccgagggcgaagggggctggggagtgggggtgcagtcatcgtggtctgaatagggaaataaaaagattaactagtacggtaaactccggtagaacggggtccaattccgtccgtactaccgagaacgaactaaacttacccgaaaagtaaccgaccgttagtaacttactaaacgaaattacggaaaaccttaagtttaacgaaggaacggtaccccggaaggtaacccgtccgggtaccttaccgttaccttaatttaacgttacgttaccggtaacgttccccttaggttccgtttaccgttacggttccgggggaacccgagggggtaacccgtcccgtcggttcccgtaaccccgttcgtaaccccg

SEQ ID NO: 410542 - DNA, 684 bp, Homo sapiens
  misc_feature: GZ8MTXP01DTMO4.44.45.E01.1.454.CMB.2.raw
  modified_base (305)..(305): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagcgtggtggagtcgtgggggagcgtggtccagccgtgggacgtccctgagctctcctgtgttgccgtcgactcagttcagtgactctgccatgcacgtcgggtcccnccgaggcctcgaggcgaagggggctgggaggtgggtgcagtcatcgtggtctaggagtaggaaagtaaaaacgaattaacgtaagtacgggtaaaaccttccgggtaaggaaacggggtcctacttccgttacccgtactacccgaagaacgtaactaaacgttaccgaaagtaacccgtaaccgttacgttaactaaccttaaacaaagttacgtaaaacgttaaagtttacggaacgtaacggaccggaaggtacccgtcggtaccttacgttacttaagtttaacgttcgttacgtacgttacccgtacgttccgttacgttcggttcggggaaccgtacgggccgtcccgtgttacccgtaaccgttccgtcccg

SEQ ID NO: 410543 - DNA, 637 bp, Homo sapiens
  misc_feature: GZ8MTXP01AHY7J.44.45.E01.1.454.CMB.2.raw
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggaggcgtggtccagccgtgggacgtccctgacgactctcctgtgttgcgtccggactcagtttcagtgactctgccatgcacgtcgggtcccgccagggcctccgagggcgaagggggctgggaggtggggtggcagtcatctggtctgagtaggaaagtaaaaagaataactaagtacggaaactccggtaggaacgggccgtattcccgtccgttcctaccgagacgactaaacgttaccaaagaaccaccgttagtaactactaacaaactagaaactaaagtttacgaagtacgacgacggtacgtcggtcttacttacgttatttaacttacgttacgacgttccctaacgttccgttcgttacggttcggggaaccgtaggggtaaccgccgttcgggttcctaaccgttcctcccg

SEQ ID NO: 410544 - DNA, 578 bp, Homo sapiens
  misc_feature: GZ8MTXP01B76CT.44.45.E01.1.454.CMB.2.raw
  modified_base (304)..(304): a, c, t, g, unknown or other
  modified_base (522)..(522): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtggggggaggcgtggtccagcctgggacgtccctgagctctcctgtgttgcgtccggactcagtttcagtgactctgccatgcacgtgggtcccnccaggcctccgagggcgaagggggctgggaggtggggtggcagtcattcgtggtctgataggaaagtaaaaagatcgtatagggaaactcgtagaacggggcattctccgtctcagagacaacttaccaaagaaccaccgtagtaactactaacaaagtacgaaactaatttagaagagaccgaggaccgtcggtctctctattaattgttacgtacnccgtactcgttcgttcgttcggggccacgggcgcccgtggttcctccgttcgtccc

SEQ ID NO: 410545 - DNA, 595 bp, Homo sapiens
  misc_feature: GZ8MTXP01DR2GT.44.45.E01.1.454.CMB.2.raw
  modified_base (284)..(284): a, c, t, g, unknown or other
  modified_base (287)..(287): a, c, t, g, unknown or other
  modified_base (290)..(290): a, c, t, g, unknown or other
  modified_base (315)..(315): a, c, t, g, unknown or other
  modified_base (321)..(321): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcgtggtttcgcgtagcgtctttaagaggtgtcagtgtcaggttcagctggtggagtcgtggggaggcgtggtccgagcgtggcgtcctgagactctcctgtgttgcgtccgactcagttcagtgctctgccatgcncgngcnccgcgcgcgcgacggacggacgggngtgggnggtggtggcgagtgtgtcgtggtgtgtagtaaggtaaaagtaaagtaagtaagtaagtaacgtaacgtacgtacggtacggtacgtacgttcgtccgtcgtacgacgaacgaactaactaacaacgaacgtacgtacgtactactaacgtaataagtaaataagtagagacgacgacgacgtcgtcgtcttacttaattagttagtacgttacgtaccgtcgttcgttcgttacggtcgggtacggaacggcgtccgttcgtccgttccgtccg

SEQ ID NO: 410546 - DNA, 579 bp, Homo sapiens
  misc_feature: GZ8MTXP01EBEA0.44.45.E01.1.454.CMB.2.raw
  modified_base (557)..(557): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtttcagctggtggagtcgtgggggaggcgtggtccagccgtgggacgtcctgagctctcctgtgttgcgtcgactcagttcagtgactctgccatgcacgtgggtcccgccaggcctccgaggcgaagggggctgggaggtggggtggcagtcagtctggtctgagtaggaaagtaaaagaataacgtagtagggaaacctccggtagaacggggcctattcctccgtctaccgagtacgaactaaacttaccaaagaaccgaccgtagttaactactaaacaaagtagaaactaatttagagacgcgagactcgctctctataattgacgacgttcccattcgttcgttcgttcgggcagggcnccgtcgcctaaccgttctcccg

SEQ ID NO: 410547 - DNA, 671 bp, Homo sapiens
  misc_feature: GZ8MTXP01A7YMU.44.45.E01.1.454.CMB.2.raw
  modified_base (297)..(297): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgctcttttaagaggtgtccagtgtcaggttcagctggtggagtcgtgggggagcgtggtccagcctgggacgtcctgagctctctgtgtgcgtcggatcagttcagtgactctgccatgcacgtgggtcccnccgaggcctccgaggcgaagggggctgggacggtggggtcggcagtcgatcgtggtctaggagtagggaaataaaaagattctagtacgggaaacttccggtagaacggggcctaagttccctccgtacctacccgaggaacgtactaaacgttaccaaagtaaccgtaccgtagttaactactaaacgtaaagtacggtaaaacttaagtttacggaaggtaacggaccggtaagggtaacctccgggtacttaccgtacttaatttaacgttcggttaacgacgttaccccgtaagttcccggttacgttaccgggttcgggggccctaggggaaccgttcccggtggttccctaacccgttcgtaaccccg

SEQ ID NO: 410548 - DNA, 646 bp, Homo sapiens
  misc_feature: GZ8MTXP01C5O16.44.45.E01.1.454.CMB.2.raw
  modified_base (302)..(302): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagctggtggagtcgtgggggagcgtggtccagcctgggacctcctgagactctcccgtgtgcgtccgactcagtttcagtgactctgccatgcacgtcgggtccnccgaggcctccgagggcgaaggggctgggagtgggtgcagtcattcgtggtcctggagtagggaaagtaaagaaattactaagtacgggtaaaacctccgggtaggaacgggtccgtaattcccgtccgtactccgagacgaactaacttaccaaacgaacctaccgtagtactactaaactaaatacggtaaactaagtttagaaggacgaccggaggtacctcggtcttcttacttatttagttaacgtaacgacgtacccttagttccgttcgttacggttcggggaccgtaaggggtaccgtcccgttcggtcccgttacccgttccttcccgtaacccg

SEQ ID NO: 410549 - DNA, 644 bp, Homo sapiens
  misc_feature: GZ8MTXP01CIX3U.44.45.E01.1.454.CMB.2.raw
  modified_base (263)..(263): a, c, t, g, unknown or other
  modified_base (300)..(300): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagctggtggagtcgtgggggagcgtggtccagcctgggacctcctgagctctctgtgtgcgtccgntcagtttcagtgactctgccatgccacgtgggtcccncgacggcctccgaggcgaagggggctgggaggtggggtggcaggtcagttcgtggtctggagtaggaaagtaaaaagtaattaacgtaagtacggaaacgtccggtaggaacggggtcctacttccgtccgtctaccgagaacgaactaacttaccgaaagtaaccgtaccgtagtaactacgtaaactaaagtacgtaaactagttagacgtacgaccgaggtaccgtcggtcttactcttaattaagttcgttacgtacgttcccgttaagttccgttaccgttcggttcggggccgacggggtcctcccggtcggttaccgtaacccgttccttaaccccg

SEQ ID NO: 410550 - DNA, 653 bp, Homo sapiens
  misc_feature: GZ8MTXP01ARM8A.44.45.E01.1.454.CMB.2.raw
  modified_base (301)..(301): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagctggtggagtcgtgggggagcgtggtccagccgtgggacgtcctgacgactctctgtgtgcgtcgactcagttcagtgactctgccatcgcacgtgggtccnccaggcctcgaggcaagggggctgggagtgggggtgcaggcatcgtggtctgagtaggaaagtaaaagaataactagacggaaacctcggtaggaacgggccgtattcctccgtactaccgagacgactaaactaccaaagaaccgtacgtagttaactaccgtaaacaaagttacggaaaacttaagtttaggaacgacggacccgaagggtaccgttacggtccttacttacttaagtttaagttacgttaccggtaccttacccgtaacgttcggtttaaccgttcgggttacggggtcccgaaggggtccgtccccgttagggttacccctaacccggttccttcccg

SEQ ID NO: 410551 - DNA, 606 bp, Homo sapiens
  misc_feature: GZ8MTXP01AW3R1.44.45.E01.1.454.CMB.2.raw
  modified_base (211)..(211): a, c, t, g, unknown or other
  modified_base (301)..(301): a, c, t, g, unknown or other
  modified_base (421)..(421): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgcttcttttaagaggtgtccagtgtcaggttcagctggtggagtcgngggggagcgtggtccagccgtgggactccctgagctctctgtgttgcgtccgactctgttcagtgactctgccatcgcacgtgggtcccnccaggctccgagggcaagggggctgggagtggggtggctagtcagtcgtggtctgatacgggaaataaaagataacgtatagggaaacctcgaggaacggcgtatcgtccgtctccaganactaataccaagaaccacgtagtactacttaacaaagtaacaataatttagaagacgacggacgtacgtccggtcttcctacttaagttaacttcgaccgtacgcctaacgttcgtttccgttacggttccggggtaaccgacggggtccgtcccgtcgggttccctaacccggttctaaccccg

SEQ ID NO: 410552 - DNA, 597 bp, Homo sapiens
  misc_feature: GZ8MTXP01AOF6Y.44.45.E01.1.454.CMB.2.raw
  modified_base (302)..(302): a, c, t, g, unknown or other
  modified_base (531)..(531): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcgtgggttttcctcgttgcttcttttaagaggtgtccagtgtcaggttcagctggtggagtcgtgggggagcgtggtccagccgtgggactccctgagactctctgtgtgcgtccgactctagttcagtgactctgccatcgcacgtcggcccncgaggcctccgaggcgaaggggctgggagtgggtgcagtcagtcgtggtctagagtagggaaagtaaaaagattaactaagtacggaaaccgtccggtaggaacgggcctattcctcgtctacgagaacaactaacttaccaaagtaccacgtataatactaaacaagtagaaactaagttagacgacgccgaagtacctacggtctcttatattaagttacgacgacnccctagtccgttacgcggttcgggaacccagggtccgtcccgtggttcctaacccgttccgtcccg

SEQ ID NO: 410553 - DNA, 593 bp, Homo sapiens
  misc_feature: GZ8MTXP01BIU1F.44.45.E01.1.454.CMB.2.raw
  modified_base (179)..(179): a, c, t, g, unknown or other
  modified_base (246)..(246): a, c, t, g, unknown or other
  modified_base (272)..(272): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggtttttcctcgttgcttcttttaagnggtgtccagttgtcaggttcagctggtggagtcgtgggggagcgtggtccagcctgggactcctganctctctgtgtgcgtcgactcagttcngtgactctgccatgcacgtcgggtccgccaggcctccgaggcgaagggggcgtgggaggtgggtggcagtcagtcgtggtctgagtaggaaagtaaaaacgaataactagtacggaaactcggtagaacgggctattctcgtctccgagagactaaattccaaagaacctaccgtagtaatactaacaaatacgtaaactaatttagaagaggaccgaggaaccgtcggtcctacttccttattaattgttacgtacgccctaagttcgttcgttacgttcggggcctacgggcgtcccgtcggttcctccgttcgtcccg

SEQ ID NO: 410554 - DNA, 638 bp, Homo sapiens
  misc_feature: GZ8MTXP01BAR8L.44.45.E01.1.454.CMB.2.raw
  modified_base (300)..(300): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagctggtggagtcgtgggggagcgtggtccagccgtgggactcctgagctctctgtgttgcgtccgatcagttcagtgactctgccatgcacgtcgggtcccncaggcctccgaggcgaagggggctgggagtgggtgcagtcagtcgtggtctagagtaggaaagtaaaagtataacgtaagtaacgggtaaacctccggtaagggaacggggtcctattccgtccgtcctaccgagacgaactaacttaccgaaagaacctacgtataactactaaactaaagtacgtaaactaagttagaagtacgaccggaggtacgtcggtccttacttacttaattaacgttacgttaacgtaccgttccctaacgttcgttaccgttacgggttcggggaaccgtagggccgtcccgtcggttccctaacccgttcctaacccg

SEQ ID NO: 410555 - DNA, 541 bp, Homo sapiens
  misc_feature: GZ8MTXP01EUCQC.44.45.E01.1.454.CMB.2.raw
  modified_base (300)..(300): a, c, t, g, unknown or other
  modified_base (342)..(342): a, c, t, g, unknown or other
  modified_base (371)..(371): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgaagctggtggagtcgtgggggagcgtggtccagccgtgggagtcctgagactctcctgtgtagctctggattcaccttcaacagacatggcatgcacgtgggcccnccaggcctccgaggacgaagggctgggagtgggtgctattangtggtatgagtaggaaattaaaataaatnttatagtagtactttccggagaacgggtcctattccactatctaccagaagactaattacgaaagaacactaactatacgtactaaggaaatagaatgccgtagacgagccgagacgaggctgttctacttcgtgtgcgagagtggtgggtctggtagataacgaagtaa

SEQ ID NO: 410556 - DNA, 673 bp, Homo sapiens
  misc_feature: GZ8MTXP01BDKE3.44.45.E01.1.454.CMB.2.raw
  modified_base (306)..(306): a, c, t, g, unknown or other
tcagacagtatatacacgaccggtgctcgatttagtgagtcagtaagggaaaggggctgggagaggagcccaacactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggactccctgagactctcctgtgttgcgtccggactctagtttcagtgactctgcccatcgcacgtggggtcccnccaggcctccgaggcgaagggggctgggagtggggtgcagtcatcgtggtctggagtaggaaagtaaagaaattactaagtacgggaaaaccttcccgggagggtaaacgggcccgtagtttcccgtacccgtcctaccgaaggtacgaactaaacttacccgaaagtaaacctacccggttagtaactacgttaaactaaagtaacggaaacttaaagtttacggaacggtaacggacccggaacggtaccgtcgggtcctacttacttaattagttaacggtaacgacgtccccttagttccgttacacgggttcggggaccgtaagggccgtcccgtcgggtccttaccgtcttaacccgtccg

SEQ ID NO: 410557 - DNA, 620 bp, Homo sapiens
  misc_feature: GZ8MTXP01AUMA0.44.45.E01.1.454.CMB.2.raw
  modified_base (274)..(274): a, c, t, g, unknown or other
  modified_base (303)..(303): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagctggtggagtcgtggggagcgtggtccagccgtgggactcctgagctctctgtgtgcgtccgatctagttcagtnactctcgccatcgcctacgtcgggtcccncgaggcctaccggaggccgaaggggcgtgggagtgggtcgcagtcagtcgtggtctagagtaggaaataaaacatctagtacggaaactcgggagaacgggctacttctcgtctacgagacgaactaactaccgaaacgaactacgtagtactactaactaaatacgaaacttaagttacgaacgacgacggtacgtaccgtcggtcttacgtcttaagtttaacgtacgttaccgtaccgttccgtaacgttcgttacgttcggttcggggaaccgacgggtaacgtccccgtggttccctaaccgttccgtcccg

SEQ ID NO: 410558 - DNA, 665 bp, Homo sapiens
  misc_feature: GZ8MTXP01EVGSD.44.45.E01.1.454.CMB.2.raw
  modified_base (253)..(253): a, c, t, g, unknown or other
  modified_base (286)..(286): a, c, t, g, unknown or other
  modified_base (290)..(290): a, c, t, g, unknown or other
  modified_base (312)..(312): a, c, t, g, unknown or other
  modified_base (403)..(403): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagtcttgggtttttcctcgttgcttcgtttttaaggaggttgtccagtgtcaggtttcagcgtggtggagtcggtgggggagcgtggtccagcccgtgggacctccngagctctctgtgtgccgtccgatctgttcagtnactncgccatcgcacgtcgggtcccncgacggcctaccggaggtacggaagggggtcgtagggggacggttgggggtggactagtcagtcgtggtctaggagtaaggaaagtaaaanaattaacgtagtaagggaaacctcggtaggaacgggcctattccgtccgtctacgaagacgtaaactaacgttaccgaaagaacctacgtaagtactaactaaactaaacgggtactaaaacggttaattacgggaaacgacgtaccggaggtacctcgggtacttacgtacttattaacgttacgacgtacttccgtagttccgttacggcggttcggggccacgggtaactcccggtggttaccctcccgttcgtccccg

SEQ ID NO: 410559 - DNA, 650 bp, Homo sapiens
  misc_feature: GZ8MTXP01DI6FJ.44.45.E01.1.454.CMB.2.raw
  modified_base (302)..(302): a, c, t, g, unknown or other
  modified_base (337)..(337): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggtttttcctcgttgcttcttttaagaggtgtccagtgtcaggttcagctggtggagtcgtgggggagcgtggtccagcctgggactcctgagctctctgtgttgcgtccgatcagtttcagtgactctgccatgccacgtcgggtcccnccaggcctccgaggcgaagggggctgggagtgggngcagtcatcgtggtctgagtaggaaagtaaaagataacgtagtacgggaaacctcgtaggaacgggcctattcctccgtctaccgagaacgaactaaacttaccaaagtaacctaccgttagtaactactaaactaaaagtacgtaaactaaagtttaggaacgtaacggacccggtaaggtaaccgtccggtaccttacttacgttaatttaacgttcggttaacgtacgttaccctaagttccgttaccgttcggttacggggtccgagggtccgtcccgtcgggttaccctaacccggttcctaaccccg

SEQ ID NO: 410560 - DNA, 594 bp, Homo sapiens
  misc_feature: GZ8MTXP01BXOHE.44.45.E01.1.454.CMB.2.raw
  modified_base (302)..(302): a, c, t, g, unknown or other
  modified_base (432)..(432): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagctggtggagtcgtgggggagcgtggtccagcctgggactcctgagactctcctgtgttgcgtccgatcagttcagtgactctgccatcgcacgtcgggtcccnccaggcctccgaggccgaagggggctgggaggtggggtggcaggtcatcgtggtctagagtaggaaagtaaaaagaattaactaagtacgggaaacctccggtaggaacggggtcctaattcctccgtcnccagacacgtaacttaccaaagaaccacgtataactactaacaaagtacgaaactaattagagagaccggagacgtcgtctctactataacttgacgtacgccctatcgttcgttcgttcggggcctaggggccgtcccgtcggttacctccgttcctcccg

SEQ ID NO: 410561 - DNA, 625 bp, Homo sapiens
  misc_feature: GZ8MTXP01DRBQG.44.45.E01.1.454.CMB.2.raw
  modified_base (297)..(297): a, c, t, g, unknown or other
  modified_base (562)..(562): a, c, t, g, unknown or other
  modified_base (600)..(600): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagctggtggagtcgtgggggagcgtggtccagcctgggacgtcctgagctctctgtgtgcgtcgatcagttcagtgactctgccatgcacgtgggtcccnccaggcctccgaggcgaaggggctggagtggtgcagtcatcgtggtctagagtaggaaataaaagattaacagtacgggaaaaccttccggaggaaacggggtccctaagtttcccgtaccgtactacccgaagaacgtaacctaaacgtttacccgaaacgaaccgtaaccgttagtaacttactaaacaaagtacgtaaacttaagttagaacgagaccgtaaggacctcggtctacttacttattaagttacgttacggacnccgtagttccgttacgttcgttcggggccagggaaccnccgtcgcctaaccgttcgtaacccg

SEQ ID NO: 410562 - DNA, 551 bp, Homo sapiens
  misc_feature: GZ8MTXP01AWUAP.44.45.E01.1.454.CMB.2.raw
  modified_base (305)..(305): a, c, t, g, unknown or other
  modified_base (354)..(354): a, c, t, g, unknown or other
  modified_base (383)..(383): a, c, t, g, unknown or other
  modified_base (451)..(451): a, c, t, g, unknown or other
  modified_base (470)..(470): a, c, t, g, unknown or other
  modified_base (476)..(476): a, c, t, g, unknown or other
  modified_base (515)..(515): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgaagctggtggagtcgtgggggaggcgtggtccagcctggggagtccctgagactctcctgtgtagcgtctggattcaccttcaacagacatggcatgcacgttcgggcccnccgaggcctccgagggccaagggggactgggaggtggggtgctagttanagtggtatggatgggaaattaaataaatnttatgtagacttccggtgaacgggccgtattcaccatctccagagacaatcgaagaacaccatatatntaggtaaatagaaatgccngaacgngaccgaaggcaacgggctagttctaacacgtgtaggcgngagaaggtgggtcggtcggtaggagtaacgaagaag

SEQ ID NO: 410563 - DNA, 631 bp, Homo sapiens
  misc_feature: GZ8MTXP01ESKLJ.44.45.E01.1.454.CMB.2.raw
  modified_base (264)..(264): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgcttcttttaagaggtgtccagtgtcaggttcagctggtggagtcgtgggggagcgtggtccagccgtgggactccctgagactctctgtgtgcgtccgntcagttcagtgactctgccatcgcacgtcgggtcccgccagggcctccgaggccgaagggggctgggaggttggggtgctagtcatcgtggtctaggagtaggaaagtaaaagaataacgtagtaggaaacctcggtaggaacgggctattcctccgtctccgaagacgaataacttaccaaagaacctacgtagtaactactaaacaaacgtagtaaactaagttagaagaccgaccggaaggtaccgtcggtacctttacgtacttaagttaacgttcgttaacgtccgttaccctaagttccgttacgttacggttcggggcccgtagggccgtacccgtcggttcctaacccggttcctcccg

SEQ ID NO: 410564 - DNA, 623 bp, Homo sapiens
  misc_feature: GZ8MTXP01AKFAQ.44.45.E01.1.454.CMB.2.raw
  modified_base (299)..(299): a, c, t, g, unknown or other
  modified_base (353)..(353): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgcttcttttaagaggtgtccagtgtcaggttcagctggtggagtcgtgggggagcgtggtccagccgtgggactcctgagctctctgtgtcgcgtcgactcagttcagtgactctgccatgccacgtgggtcccncaggcctccgaggcgaagggggctgggagtggggtgcgtagtcagtcgtggtcngtaagtaggaaagtaaaaaacgattaacgtatacgggaaactccggtaaggaacggggcctattcctccgtcgtaccaagaacgtaacaacttaaccgaacgtaaacgtaccgttagtaactactaactaaaatagtaaaactaagttacgaagacgaccgaggtactcggtacttctactattaagttcgttacggacttacctaagtccgttacgttcggttcggggccgtagggccgtcccgtgggttccctaaccggttcctcccg

SEQ ID NO: 410565 - DNA, 594 bp, Homo sapiens
  misc_feature: GZ8MTXP01BUV6Z.44.45.E01.1.454.CMB.2.raw
  modified_base (305)..(305): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcgtgggttttcctcgttagctcttttaagaggtgtccagtgtcaggttcagctggtggagtcgtgggggagcgtggtccagccgtgggacgtccctgagctctcctgtgttgcgtccggactcagtttcagtgactctgccatgcacgtcgggtccnccaggcctccgagggccgaagggggctggagtgggtgcagtcatctggtctgatggaaagtaaaagaataacgtatacgggaaactccggtagaacggggtccctaattcctccgtctaccagacgaacaacttaccaagaaccaccgtataatactaacaaatagaaactaattagagacgcgaggactcggtctctcttattaattgttacgacgttccctagtccggttcttcgttcgggggccctaaggggccgtccgtcgggttcctaacccggttctaacccg

SEQ ID NO: 410566 - DNA, 604 bp, Homo sapiens
  misc_feature: GZ8MTXP01A1KMJ.44.45.E01.1.454.CMB.2.raw
  modified_base (299)..(299): a, c, t, g, unknown or other
  modified_base (415)..(415): a, c, t, g, unknown or other
  modified_base (518)..(518): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgctcttttaagaggtgtccagtgtcaggttcagctggtggagtcgtgggggagcgtggtccagccgtgggacgtcctgagctctctgtgtgcgtcgctctagttcagtgactctgccatcgcacgtgggtcccncgaggctccgaggacgaagggggtctgggacggtgggtcggctagtcagtcgtggtctgaagtggaaataaaagataacgtagtacggaaactcggtagaacgggctatctcgtcncagacataactaccaagaacacgttatactacaacaaatactaaatagttagacgacgacgacggactcgtctcttacgtattaacgttacgttaccggtacncccgtaagttcccgtttacgttccggttacggggaacccgaggggtaaccctacccggtcgggttacctaacccggttccttcccg

SEQ ID NO: 410567 - DNA, 623 bp, Homo sapiens
  misc_feature: GZ8MTXP01DCSRJ.44.45.E01.1.454.CMB.2.raw
  modified_base (338)..(338): a, c, t, g, unknown or other
  modified_base (564)..(564): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgctcttttaagaggtgtccagtgtcaggttcagctggtggagtcgtgggggagcgtggtccagccgtgggacctccctgagactctcctgtgtgccgtccgactctagttcagtgactctgccatgccacgtggtcccgccaggcctcgaggcgaaggggctgggaggtgggngacagtcagtcgtggtctaggaagtagggaaaagtaaaaaagtaattaacgtaagtaacgggaaaaccttccggtaggaacggggtcctaacgttccgtaccgtctaccgacgaacgaactaaacttaccgaaacgtaaccaccgtagtaactactaaacaaagtaacgaaactaatttagagacgccggagtaccgtcgtctctcttattaagtcgttacgtacnccgtatcgttacgttcggcgggaacgcgggcgtccgtcgttcctaaccgttccgtcccg

SEQ ID NO: 410568 - DNA, 650 bp, Homo sapiens
  misc_feature: GZ8MTXP01BG39V.44.45.E01.1.454.CMB.2.raw
  modified_base (309)..(309): a, c, t, g, unknown or other
  modified_base (411)..(411): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagtcttgggttttcctcgttgcttcttttaagaggtgtccagtgtcaggttcagctggtggagtcgtgggggagcgtggtccagccgtgggaccgtccctgagctctctgtgttgccgtccgactctagttcagtgactctgccatcgctacgtcgggtcccncgaggccctaccggagggacgaaacgggggctgggggacggttgggggtcgacgtagtccgattccgtaggtctaggagtagaaagtaaaaagataacgtanacgggtaaactccggtaggaacgggcctattccgtcgtactacgacgagactaaacgtacaaacgtaaccgacgttactaactactaacaaagtacgaaactaattagaagtacgaccggtacgacgtaccgtctacttaccttaagtttaatacgttacgtaccgcctaacgttccgttacgttcggttcgggaaccgtagggaaccgtccggtcgttacccgtccgttcgtaacccg

SEQ ID NO: 410569 - DNA, 669 bp, Homo sapiens
  misc_feature: GZ8MTXP01BGM61.44.45.E01.1.454.CMB.2.raw
  modified_base (311)..(311): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagtcttgggttttcctcgttgcttcttttaagaggtgtccagtgtcaggttcagctggtggagtcgtggggagcgtggtccagccgtgggatcgtccctgagactctctgtgttgcgtcgactcagttcagtgactctcgcctatcgcctacggtcgggtccccncgaggtcctaccgaggtacggaagggggtcttaggggacggttgggggtacgacctagtcgtacgttccgtgggtctaggaagtaggaaaaaaagttaaagaactacgtaagtacggtaaaccgtccggtaagggaaacgggtccctacttccgtccgtactacgaacgacgtaacctaacttaccgaaacgtaaccaccgttatactaaccgtaaagaaacttacgaaactagttacgaagtacgacgacggtacctcgtactcttactaatttacttacggtacaccgtacctacgtttcgttccgttacggtcgggaccgtaacgggtacctccgttacggtccttaaccgtccc

SEQ ID NO: 410570 - DNA, 649 bp, Homo sapiens
  misc_feature: GZ8MTXP01EJ07T.44.45.E01.1.454.CMB.2.raw
  modified_base (247)..(247): a, c, t, g, unknown or other
  modified_base (302)..(302): a, c, t, g, unknown or other
  modified_base (547)..(547): a, c, t, g, unknown or other
  modified_base (558)..(558): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagtcttgggttttcctcgttgcttcttttaagaggtgtccagtgtcaggttcagctggtggagtcgtgggggagcgtggtccagccgtgggacctcctganctctctgtgtgcgtcgatctagttcagtgactctcgccatcgcacgtcgggtccnccgaggcctccgaggcgaagggggtctgggacggtggggtggactagtcactcgtggtctagagtaggtaaactaaaagaattaacgtagtaacggaaaccgttccgggagggtaaacggggccttacgtttcccgcccgtactaccgaaggtaactaactaaacttaccgaaacgtaccgaccgttagtaactaccgtaaacaaagtacgtaaactaattacggagaacgcgacgtacgtcgtnttctacttatntacgttcgtacgccctaattcgttaccgttcgggttccgggaaccgtaggggtaaccgtcccggtcgttcccgtaaccgttccgtaacccg

SEQ ID NO: 410571 - DNA, 618 bp, Homo sapiens
  misc_feature: GZ8MTXP01A4IXC.44.45.E01.1.454.CMB.2.raw
  modified_base (160)..(160): a, c, t, g, unknown or other
  modified_base (176)..(176): a, c, t, g, unknown or other
  modified_base (299)..(299): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttccncgttgctcttttaagnggtgtccagtgtcaggttcagctggtggagtcgtggggagcgtggtccagcctgggactccctgagactctcctgtgttgcgtccgatcagtttcagtgactctgccatcgcacgtgggtccncaggctccgaggcgaaggggctgggaggtgggtgctagtcagtcgtggtctaggagtagggaaagtaaaaagattaacgtagtacgggaaaccttccgggtaggaacggggtcctattcctccggtctaccgagacgaactaacgttccaaagtaaccaccggtagtaactacgtaacaaagtcgaaactagttgaacgagtccgaggtacctcggtctacgtacttagttaagtcgttacgacgttccctaagttcggttacgttcgttacgggtaacccgagggaacctcccgtggttcctaaccggttctaacccg

SEQ ID NO: 410572 - DNA, 648 bp, Homo sapiens
  misc_feature: GZ8MTXP01AY6V8.44.45.E01.1.454.CMB.2.raw
  modified_base (266)..(266): a, c, t, g, unknown or other
  modified_base (279)..(279): a, c, t, g, unknown or other
  modified_base (298)..(298): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggactcctgagactctctgtgttgcgtcggactcngttcagtgactcngccatgcacgtgggtcccnccgaggcctccgaggcgaagggggctggggagtggggtggcagtcatcgtcggtctggagtagggaaagtaaaagataactagtagggaaacctccggtaggaacggggtccctattcccgtaccgtcctaccgaaggaacgaacctaaacttacccgaaaggtaacccgtacccggttagttaactaactaaactaagtaacgtaaacgttaagttacggaagaccggacggaacggtacgtccgtcttacgttattagttaagttacgacgaccgttcctacgttcgttaccgttcgggttcgggccggtagggccgtcccgttcggttaccgtcccgttccgtcccg

SEQ ID NO: 410573 - DNA, 493 bp, Homo sapiens
  misc_feature: GZ8MTXP01B8U5L.44.45.E01.1.454.CMB.2.raw
  modified_base (320)..(320): a, c, t, g, unknown or other
  modified_base (477)..(493): a, c, t, g, unknown or other
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctaacaaatgaacaatttgagagccgaggactcggctctctattatgtacgagccattcgttctacgtggggccagggacgtccgtggtcctacccgtctccctcacgtccctaccgacccgaacgggccccacgttccggtccccttccccccgngggcccgcccctcgcctccgacggacgcccgaccctccggagacgccaacgcggccggccccgtgggcctcggccgtcggtacaacggtacccttaccttacgtatacttacttacgtcgtggaggccggggctgggaccgaagggcgacaagtcgnnnnnnnnnnnnnnnnn

SEQ ID NO: 410574 - DNA, 616 bp, Homo sapiens
  misc_feature: GZ8MTXP01DM7P2.44.45.E01.1.454.CMB.2.raw
  modified_base (240)..(240): a, c, t, g, unknown or other
  modified_base (302)..(302): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttggctgagcttgggttttcctcgttgcttcttttaagaggtgtccagtgtcaggttcagctggtggagtcgtgggggagcgtggtccagcctgggactccngagactctcctgtgttgcgtccgactcagtttcagtgactctcgccatgcacgtgggtcccnccaggcctcgaggcgaaggggctggagtgggtgcagtcagtcgtggtctagagtaggaaagtaaaaaagatcgtaagtacgggaaaactccggtaggaacgggtcctattccgtccgtactaccgagacgaactaacttaccaaacgaaccaccgtagtaactactaaacaaagtacgtaaactaagtttagaagacgaccggaggtaccgtcggtcttacgtacttattaagttcgacgtacgttacccgtagttccgttcgttacggttcggggccgagggccgtcccgtcggttcctaaccgttcctcccg

SEQ ID NO: 410575 - DNA, 578 bp, Homo sapiens
  misc_feature: GZ8MTXP02GNLRT.44.45.E01.1.454.CMB.2.raw
  modified_base (276)..(276): a, c, t, g, unknown or other
  modified_base (299)..(299): a, c, t, g, unknown or other
  modified_base (553)..(553): a, c, t, g, unknown or other
tcagacagtatatacacgaccggtgctcgatttagtgagtcagtaagggaaagggctgggagaggagcccagcactagaagtcggcggtgtttccattcggtgatcagcactgaacacagaggactcaccatggagtttgggctgagcgtggtttcctcgttgctctttaagaggtgtccagtgtcaggttcagctggtggagtcgtgggggaggcgtggtccagcctgggacgtcctgagactctcctgtgttgcgtccggactcagtttcagtnactctgccatgcactggggtccnccaggcctccgaggcaaggggctggaggtgggtggcagtcagtcgtggtctgatggaaataaagatactataggaaactccggtagaaacgggcctattcctccgtctccagacgaactaacttaccaaaagaacctaccgtataactactaaacaaatagaaactaatttagaagacgccgaggactcggctctacttaattagttacgtaacgactccctaattccgttactacgtcggggccgacgggacnccccgtaggtccaccggttccctcg

SEQ ID NO: 410576 - DNA, 537 bp, Homo sapiens
  misc_feature: GZ8MTXP02JUI1A.44.45.E01.1.454.CMB.2.raw
tcagacagtatatacacgaccggtgctcgatttagtgagtcagtaagggaaagggctgggagaggagcccagcactagaagtcggcggtgtttccattcggtgatcagcactgaacacagaggactcaccatggagtttgggctgagcgtgggtttcctcgttgctcttttaagaggtgtccagtgtcaggttcagctggtggagtctgggggaggcgtggtccagcctgggacgtccctgagactctcctgtgttgcgtccggactcagtttcagtgactctgccatgcactgggtccgccagggctccaggcaaggggctggagtgggtggcagtcatctggtctgatggaataaagatctatggaaactccgtgaagggccgattctccgtctccagagacaattccaagaacaccgtagtatactaacaaatgaaactaatttgaagagaccgaggactcggctctctattattgtacgacgccctatcgttctacgtggggcccaggggacgccctggtccaccggtctccg

SEQ ID NO: 410577 - DNA, 547 bp, Homo sapiens
  misc_feature: GZ8MTXP02JESY0.44.45.E01.1.454.CMB.2.raw
  modified_base (298)..(298): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtctgggggagcgtggtccagcctgggacgtcctgagactctcctgtgttgcgtccggactcagttcagtgactctgccatgcactgggtccnccaggctccgaggcaaggggctggagtggtgcagtcatctggtctgatggaagtaaagatactatggaaactccgtagaacgggccgtattcctaccgtctcccagacgacaattccaaagaacaccgtagtactactaacaaatgaaactaattagagagccgaagactcggctactctatttatgtacgacgtacccattcgtactacgtggggcccaagggacgcccgtaggcctaccgtctcccg

SEQ ID NO: 410578 - DNA, 559 bp, Homo sapiens
  misc_feature: GZ8MTXP02GYFXN.44.45.E01.1.454.CMB.2.raw
  modified_base (298)..(298): a, c, t, g, unknown or other
tcagacagtatatacacgaccggtgctcgatttagtgagtcagtaagggaaagggctgggagaggagcccagcactagaagtcggcggtgtttccattcggtgatcagcactgaacacagaggactcaccatggagtttgggctgagcgtggtttcctcgttgctctttaagaggtgtccagtgtcaggttcagctggtggagtcgtgggggagcgtggtccagcctgggactcctgagactctcctgtgttgcgtccggactcagtttcagtgactctgccatgcactggggtcccnccaggctccaggcaaggggctggagtggggtgcagtcatctggtctgatagggaaataaagaatactagtacggaaaactccggtagaaaggggcctattcctccgtctccgagacgaactaacttaccaaagaaccaccgtagtactactaacaaatgaaactaatttgaagagccgagactcggctctctattacttgtacgacgcccatccgttactacgtcggggccaggggacgcccgtggtcctaccgtctcccg

SEQ ID NO: 410579 - DNA, 497 bp, Homo sapiens
  misc_feature: GZ8MTXP02J2JRK.44.45.E01.1.454.CMB.2.raw
  modified_base (300)..(300): a, c, t, g, unknown or other
  modified_base (305)..(305): a, c, t, g, unknown or other
  modified_base (313)..(313): a, c, t, g, unknown or other
  modified_base (315)..(315): a, c, t, g, unknown or other
  modified_base (317)..(317): a, c, t, g, unknown or other
  modified_base (319)..(319): a, c, t, g, unknown or other
  modified_base (322)..(322): a, c, t, g, unknown or other
  modified_base (324)..(329): a, c, t, g, unknown or other
  modified_base (331)..(334): a, c, t, g, unknown or other
  modified_base (343)..(344): a, c, t, g, unknown or other
  modified_base (346)..(346): a, c, t, g, unknown or other
  modified_base (352)..(352): a, c, t, g, unknown or other
  modified_base (355)..(355): a, c, t, g, unknown or other
  modified_base (368)..(368): a, c, t, g, unknown or other
  modified_base (375)..(375): a, c, t, g, unknown or other
  modified_base (382)..(382): a, c, t, g, unknown or other
  modified_base (400)..(400): a, c, t, g, unknown or other
  modified_base (402)..(402): a, c, t, g, unknown or other
  modified_base (405)..(405): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtctgggggagcgtggtccagcctgggacgtccctgagactctcctgtgttgcgtccggactcagtttcagtgactctgccatgcactgggtccncagcncagcaggngngngnggngnnnnnngnnnngagaagaannanagaacncgngagcgatctctcncagaganatacaanaacactatatatacaaananaanaattagagagacgagacgcgctctctattattagtacgacgaccactcgtacgtacgtacggcggacggacgccgtcgtcgtaccgtactcc

SEQ ID NO: 410580 - DNA, 627 bp, Homo sapiens
  misc_feature: GZ8MTXP02HGUYF.44.45.E01.1.454.CMB.2.raw
  modified_base (301)..(301): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggacgtcctgagactctcctgtgttgcgtccggatcagttcagtgactctgccatgcacgtcgggtcccnccaggcctccgaggccgaaggggctgggaggtggggtgctagtcagttcgtcggtctggatagggaaaagtaaaagaatactaagtacggaaaacctccgtaggaacgggcctattcctccgtctaccagagactaatacccaaagaacacgtagtactactaaacaaatagtaaactaagtttacgaagacggaccgaaggaccgtacggtcttacgttacttaatttacgttagtaccgacgtaccctacttcccgttacgttaccggtcggggaacccgtaacggggaccgtaccccggtggtcccacccggtttcctccccg

SEQ ID NO: 410581 - DNA, 574 bp, Homo sapiens
  misc_feature: GZ8MTXP02H4R24.44.45.E01.1.454.CMB.2.raw
  modified_base (300)..(300): a, c, t, g, unknown or other
  modified_base (483)..(483): a, c, t, g, unknown or other
  modified_base (551)..(551): a, c, t, g, unknown or other
  modified_base (563)..(563): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggactccctgagactctcctgtgttgcgtccggatcagtttcagtgactctgccatgcacgtgggtccnccagggctccgaggcaaggggctggagtgggtgcagtcatcgtggtctgataggaataaagatacgtataggaaacctcgtagaacgggcctaattccgtccgtctccagacgactaaattaccaaagaaccaccgtgtaactactaacaaaatgaaaactaatttagagagccgaaggtacncggactctacttaattattgtaacgacgtaccctagtcgttactacgtcggggaacccaggggtaccncccgtggtaccnccgttctcccg

SEQ ID NO: 410582 - DNA, 578 bp, Homo sapiens
  misc_feature: GZ8MTXP02JMHL7.44.45.E01.1.454.CMB.2.raw
  modified_base (300)..(300): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggacgtcctgagactctcctgtgttgcgtccgactcagttcagtgactctgccatgcacgtcgggtccnccaggcctccgaggccgaaggggctgggagtgggtgcagtcatctggtctgataggaagtaaagatacgtagtaggaaacctccgtagaagggactattctccgtctccgagacgactaattccaaagaaccaccgtagtactactaacaaatacgaactaattacgaagtacgaccgaaggactacggctactactattattcgtaacgacgccctaacttccgttactacgtcggggccgtagggaccgtcccggtcgtcctaccggtcctacccg

SEQ ID NO: 410583 - DNA, 539 bp, Homo sapiens
  misc_feature: GZ8MTXP02FV8XQ.44.45.E01.1.454.CMB.2.raw
  modified_base (280)..(280): a, c, t, g, unknown or other
  modified_base (302)..(302): a, c, t, g, unknown or other
  modified_base (333)..(333): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggaggcgtggtccagcctgggacgtccctgagactctcctgtgttgcgtccggactcagtttcagtnactctgccatgcacgtgggccncaggctccgaggccaaggggctggagtgggnggcagtcatctggtctgatggaataagatcataggaaactccgagaagggccattctcgtctcagagacaatccaagaacaccgtagtactactaacaaatagaaactaatttagaagagccgaggactcggactctatacttattgaacgacgcctagtccgttactacgtcgggccgacgggacgccgtggtccaccgtctccg

SEQ ID NO: 410584 - DNA, 715 bp, Homo sapiens
  misc_feature: GZ8MTXP02G2T1V.44.45.E01.1.454.CMB.2.raw
  modified_base (160)..(160): a, c, t, g, unknown or other
  modified_base (305)..(305): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcgtgggtttccncgttagctctttaagaggtgtccagtgtcaggttcagctggtggagtcgtgggggagcgtggtccagcctgggactccctgagactctcctgtgttgcgtccggactcagtttcagtgactctgccatggcacgtggggtccccncgacggcctacgaggacggaaggggtcgtaggggagggtggggtcggacgtacgtcgtagttcggtccggtacgtaggtaagtaagggaaaagttaaacgaacttacgttaagtaacgggtaaaccgttaccgggtagggtaaccgggtccttaacgttcccgtccgtaccgtaccgaagtacgtaactaactacccgaaacgtaaccgtacgtataactaaccgtaaacgtaaaacgtacgtaaacttaagttacggaacggtaacgaccggtacggtaccgtaccggtcttacgtacgtttaacgtttacgttacggtaaccgtacgtaccctacgttcccgttaccgtacgggtacggggaaccgtacgggtaccgtacccggtcggtacccgtacccgtcctaccg

SEQ ID NO: 410585 - DNA, 569 bp, Homo sapiens
  misc_feature: GZ8MTXP02GYP7K.44.45.E01.1.454.CMB.2.raw
  modified_base (298)..(298): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtctgggggagcgtggtccagcctgggactccctgagactctcctgtgttgcgtccggactcagttcagtgactctgccatgcactgggtccnccaggctccgaggcaaggggctggagtgggtgcagtcatctggtctgataggaagtaaagatactatcggaaactccgtagaacggggcctattcgtcccgtctccgagacgaacaacttccaaagaacaccgtagtaactactaacaaatgaaactaatttagagacgccgaggactcggctcgtctaattactagtacgacgccctacgttccgttctaacgtcggggaaccgtacggggacgtcccgtcggtcctacccggtctcccg

SEQ ID NO: 410586 - DNA, 606 bp, Homo sapiens
  misc_feature: GZ8MTXP02F0ZCL.44.45.E01.1.454.CMB.2.raw
  modified_base (301)..(301): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggacgtccctgagactctcctgtgttgcgtcggactcagtttcagtgactctgccatgcacgtgggtccncaggctccgaggcgaaggggctggagtggggtggcagtcagtcgtggtctgagtaggaaagtaaacgaattactatagggaaaacctccggtagaaacggggccctaattccgtaccgtctacccgaaggacgaactaaacttacccaaaagaaaccaccggtatactacgtaaacaaaattgaaactaaatttaggaagacgccgaaggtacctacggctacgtactaatttatggtacgacgccctaattccgttactacgtcggggaaccaggggtacgtccgtggtaccaccgtctacccg

SEQ ID NO: 410587 - DNA, 545 bp, Homo sapiens
  misc_feature: GZ8MTXP02I59D8.44.45.E01.1.454.CMB.2.raw
  modified_base (301)..(301): a, c, t, g, unknown or other
  modified_base (349)..(349): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggaggcgtggtccagcctgggacgtccctgagactctcctgtgttgcgtccggactcagttcagtgactctgccatgcactgggtccnccaggcctccgaggccaaggggctggagtgggtgcagtcatctggtcngatggaataaagatctatggaaactccgtgaacgggcctattctcgtctcagagactaatccaagaacaccgtagtactactaacaaatgaactaatttgaagacgccgaggactcggctactctattatgtacgacgtcccattcgttactacgtcggggaaccgacgggacgtcccgtggtccaccgtctcccg

SEQ ID NO: 410588 - DNA, 530 bp, Homo sapiens
  misc_feature: GZ8MTXP02JMBXA.44.45.E01.1.454.CMB.2.raw
  modified_base (508)..(508): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtctgggggagcgtggtccagcctgggactccctgagactctcctgtgttgcgtccgactcagttcagtgactctgccatgcactgggtccgccagggctccgaggcaaggggctgggagtgggtgcagtcatctggtctgatggaataagatactatggaaactcgagaaggccattctcgtctccagagacaattccaaagaacaccgtgtatctaacaaatgaacaatttgaagagccgaggactcggactctctattattgtacgacgcccattccgtactacgtggggccaggggacncccgtaggtccaccgtctaccc

SEQ ID NO: 410589 - DNA, 557 bp, Homo sapiens
  misc_feature: GZ8MTXP02GSRL9.44.45.E01.1.454.CMB.2.raw
  modified_base (298)..(298): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgctcttttaagaggtgtccagtgtcaggttcagctggtggagtcgtgggggagcgtggtccagcctgggactccctgagctctctgtgttgcgtccgactcagttcagtgactctgccatgcacgtgggtccncaggctccgaggcaaggggctggagtgggtgcagtcatcgtgtctgataggaaataaagatactatagggaaactccgtagaacgggcctatctcgtctcagagactaactcaaagacaccgtatactactaacaaatagaaactatttagaagacgtaccgaggtactacggctacgtctaatttatacgtacgacgtaccccattccgttactacggcggggtaaccgagggcgtcccgtggtccaccgttctcccg

SEQ ID NO: 410590 - DNA, 528 bp, Homo sapiens
  misc_feature: GZ8MTXP02G5477.44.45.E01.1.454.CMB.2.raw
  modified_base (297)..(297): a, c, t, g, unknown or other
  modified_base (396)..(396): a, c, t, g, unknown or other
  modified_base (446)..(446): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggactcctgagactctctgtgttgcgtccgactcagttcagtgactctgccatgcacgtgggtccnccaggcctccgaggccaaggggctggagtggggtgcagtcatctggtctgatggaataaagatcataggaaactcgtagaaggccatctcgtctcaganacaattccaaagaacaccgtagtatactaacaaatagaaacaatttaganacgacgaggactcggctactctattactgtacagcccatcgttactacgtcggggccacgggacgccgtgccaccgtctccc

SEQ ID NO: 410591 - DNA, 629 bp, Homo sapiens
  misc_feature: GZ8MTXP02HSQ59.44.45.E01.1.454.CMB.2.raw
  modified_base (297)..(297): a, c, t, g, unknown or other
  modified_base (347)..(347): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgcttcttttaagaggtgtccagtgtcaggttcagctggtggagtcgtgggggagcgtggtccagcctgggactcctgagctctctgtgttgcgtcgatcagttcagtgactctgccatgccacgtgggtcccnccaggcctccgaggcgaaggggctgggagtgggtgcagtcatcgtggtcngataggaaagtaagatctagtacggaaacttccggtaggaacgggtcctattccgtccgtactccaagacgaactaacttaccaaacgaaccgtaccgtataactactaaacaaatacgaaactaagttagagacgaccgagtacgtcggtactcgtactagtttacgttacgtacgtaacgtccccgttagttaccgttaccgttaaccggtcgggggtaacccgtacgggggaacccgttaccccggtcggttaccccgtacccggtttaccgttccccg

SEQ ID NO: 410592 - DNA, 645 bp, Homo sapiens
  misc_feature: GZ8MTXP02G7WLD.44.45.E01.1.454.CMB.2.raw
  modified_base (306)..(306): a, c, t, g, unknown or other
  modified_base (342)..(342): a, c, t, g, unknown or other
  modified_base (354)..(354): a, c, t, g, unknown or other
  modified_base (359)..(359): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagctggtggagtcgtgggggagcgtggtccagccgtgggacgtccctgagactctcctgtgttgcgtccgatcagtttcagtgactctgccatcgcacgtcgggtcccnccagggcctccgaggcgaaggggctgggaggtgggngcagtcagtcgnggtcngtagtaggaaagtaaagatacgtagtacggaaactccgtaggaacgggcctattccgtccgtctccgaagtaacgaactaacttaccaaacgaacctaaccgtagtaactactaaactaaaatacgtaaactaagtttagaacgaacgaccggaacggtacctcggtaccttacgtacttaatttacgttacgttacgacgtaccctaacgttccgttaccgtacggtacggggtaaccgaacggggtaccgtacccggtacggtaccctacccggtcctaccccg

SEQ ID NO: 410593 - DNA, 612 bp, Homo sapiens
  misc_feature: GZ8MTXP02GH7PN.44.45.E01.1.454.CMB.2.raw
  modified_base (299)..(299): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggacgtcctgagactctctgtgttgcgtccgactcagttcagtgactctgccatgcacgtgggtcccncagggcctccgaggcaaggggctggagtggggtgcagtcatcgtggtctgatgggaaagtaaagaatacgtagacggaaacttccggtagaacggggcctattccgtccgtcctaccgagacgaactaacttaccgaaagtaaccaccgttagtaactctaaacgaaattgaaactaatttgaagtacgaccggaggactcggacttctacgttatttagttacgtacgtacgtccctaacgttccgttacgtaccggttacggggcccgaacggggtaccgtcccgttacggtcccgtacccgtcgttcccg

SEQ ID NO: 410594 - DNA, 567 bp, Homo sapiens
  misc_feature: GZ8MTXP02JZSJX.44.45.E01.1.454.CMB.2.raw
  modified_base (301)..(301): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggacgtccctgagctctctgtgttgcgtccggactcagtttcagtgactctgccatgcacgtgggtcccncaggcctccgaggccaaggggctgggaggtgggtgcagtcagtcgtggtctgataggaaagtaaagatacgtagtacggaaactccggtagaacgggtcctagttcctccgtctaccgagacgaactactaccaacgaactaccgtgtactactaacaaatagaactattagagacgaccgaggacgtcgctctctattacttagtacgacgtcctacgttcgttacgtcgtcgggccgacgggacgtccgtgtccaccgtctccg

SEQ ID NO: 410595 - DNA, 665 bp, Homo sapiens
  misc_feature: GZ8MTXP02FXQVB.44.45.E01.1.454.CMB.2.raw
  modified_base (308)..(308): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagttgtcaggttcagctggtggagtcgtgggggaggcgtggtccagccgtgggacgtcctgagactctctgtgtgcgtccgactctagttcagtgactctcgccatcgctacgtcgggtcccnccgaggcctccgaggcgaaggggctgggaggtggggtggctagtcagtcgtcggtctagagtaggaaaagtaaagtaactacgtaagtacggtaaaacttccggtagaacgggtcccgttattccgtccgtacctaccgaagacgaactaaacttaccaaacgtaaacctaccgttagtaacttaacctaaactaaaagtacgtaaacttaaagtttaggaacgtacggaccgacggtaccgtcggtctacttacgttatttacgttacgtaacgaccgtaccctacgttccgttaccgtaccggtcggggaaccgtacgggacgtcccggtcggtaccgtacccggttcctacccg

SEQ ID NO: 410596 - DNA, 400 bp, Homo sapiens
  misc_feature: GZ8MTXP02FGHSY.44.45.E01.1.454.CMB.2.raw
  modified_base (398)..(400): a, c, t, g, unknown or other
tcagacagtatatacacgaccggtgctcgatttagtgagtcagtaagggaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttccccctggccgccctgctccaggagcacctccgagagcacagcggccctgggctgcctggtcaaggcctacttccatatactgtctgagcgggctggcaaggcgcatagnnn

SEQ ID NO: 410597 - DNA, 578 bp, Homo sapiens
  misc_feature: GZ8MTXP02JR9M8.44.45.E01.1.454.CMB.2.raw
  modified_base (302)..(302): a, c, t, g, unknown or other
  modified_base (375)..(375): a, c, t, g, unknown or other
  modified_base (413)..(413): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggactccctgagactctcctgtgttgcgtccggactcagtttcagtgactctgcccatgcacgtgggtccnccaggcctcgaggcgaaggggctgggagtgggtgcagtcagtcgtggtctgatagggaaataaagatacgtanaggtaaactccgtagaacgggcctatctcgtctcaganacaatccaagacaccgtatactacaacaaatagaaactaatttagaagacgaccggaagacgtcggcttcgtactaacttacttacgtacgacacccctagttccgtaacgtcgtacggggaaccgtacggggacgtcccgttacggtacctacccgtctacccg

SEQ ID NO: 410598 - DNA, 593 bp, Homo sapiens
  misc_feature: GZ8MTXP02FR1HG.44.45.E01.1.454.CMB.2.raw
  modified_base (302)..(302): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggaggcgtggtccagccgtgggacgtccctgagactctcctgtgttgcgtccgactcagttcagtgactctgccatgcacgtggtcccncaggctccgaggcaaggggctggaggtgggtggcagtcagtcgtggtctgataggaaagtaaaagattactagtaggaaaaccttccggtaggaaacggggtccctatttccgtcccgttcctacccgaagacgactaatacccaaagaaccaccgtagtactactaacaaatagaactaattagaagacgacgaggtactacggctactctattattacgtacgacgtccctacgttcgttacgtacgtggggaaccgacgggtacgcccgtcggtccaccgtctacccg

SEQ ID NO: 410599 - DNA, 549 bp, Homo sapiens
  misc_feature: GZ8MTXP02GP4BP.44.45.E01.1.454.CMB.2.raw
  modified_base (344)..(344): a, c, t, g, unknown or other
tcagacagtatatacacgaccggtgctcgatttagtgagtcagtaagggaaagggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggactccctgagctctcctgtgttgcgtccggatcagtttcagtgactctgccatgcacgtgggtccgcagggcctccgaggcgaaggggctggagtggggtgcagtcattcgnggtctgagtaggaaagtaaagaatcgtaatgggaaactccggtagaacgggcctattctccgtctaccagagacaattaccaagacacgtgtaactactaacaaatgaaacattagagacgcgagctacggctctctattatgtacgactcccgtatccgtactacgtcggggccgaagggtcgcccgtaggtcctaccgtctcc

SEQ ID NO: 410600 - DNA, 588 bp, Homo sapiens
  misc_feature: GZ8MTXP02F4FLF.44.45.E01.1.454.CMB.2.raw
  modified_base (303)..(303): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggaggcgtggtccagcctgggacgtccctgagactctcctgtgttgcgtcctgactcagtttcagtgactctgccatgccactgggtccncaggctccaggcaaggggctgggagtggggtgcagtcatccgtggtctgatggaaagtaaagatactaatagggaaaaccttccggtagaaacgggtcccgtaattccgtccgtactaccagacgaacaaacttaccaaacgaacctaccgtagtaactactaaacaaatagaaactaatttagaagacgaccgaggtactcggctctctacttattacgtacgacgacctactccgttcgtacgtcggggaccgacgggtacgcccgtacggtccgtaccgtcc

SEQ ID NO: 410601 - DNA, 601 bp, Homo sapiens
  misc_feature: GZ8MTXP02H57XP.44.45.E01.1.454.CMB.2.raw
  modified_base (352)..(352): a, c, t, g, unknown or other
tcagacagtatatacacgaccggtgctcgatttagtgagtcagtaagggaaagggctgggagaggagcccagcactagaagtcggcggtgtttccattcggtgatcagcactgaacacagaggactcaccatggagtttgggctgagctgggttttcctcgttgcttcttttaagaggtgtccagtgtcaggttcagctggtggagtcgtgggggagcgtggtccaggccgtgggactccctgagactctctgtgttgcgtccgactcagtttcagtgactctgccatgccacgtcgggtccgccagggcctccgaggccgaaggggctggagtggggtgcagtcatcgtgntgataggaaagtaaagatactagtaggaaactccgtagaacgggcctatcctccgctaccgagacgactaactaccaaagaaccaccgtagtaactactaacaaagtcgtaaaactagtttagagtacgaccgacggactacggccttactacgttatttacgtcgttaccgactccctaacgttccgttacgtaccggtcggggaaccgtacgggaccgtcccggtacgtccgacccgtttccgcccg

SEQ ID NO: 410602 - DNA, 627 bp, Homo sapiens
  misc_feature: GZ8MTXP02HNM5Q.44.45.E01.1.454.CMB.2.raw
  modified_base (300)..(300): a, c, t, g, unknown or other
  modified_base (335)..(335): a, c, t, g, unknown or other
  modified_base (341)..(341): a, c, t, g, unknown or other
  modified_base (351)..(351): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagccgtgggacgtccctgagctctcctgtgttgcgtccgatcagttcagtgactctgccatgcacgtcgggtccnccaggcctccgaggcgaaggggctggaggtggggngcagtnatcgtggtcngagtagggaaagtaaagaatacgtagtaggaaacctccgtaagggaacggtccgtaattccgtccgtcctaccgaagacgaactaaacttaccaaagtaacctaccgtagtaactactaaacaattaacgaaacttaagttaggaagtacggaccgaggtaccgtcggtcttactacttattacgttacgtaagaccgtacccgtaacgttcgttaccgttacggtcggggaacccgtaaggggacccgtcccgtcggtccctacccggtctcccg

SEQ ID NO: 410603 - DNA, 609 bp, Homo sapiens
  misc_feature: GZ8MTXP02HECFL.44.45.E01.1.454.CMB.2.raw
  modified_base (278)..(278): a, c, t, g, unknown or other
  modified_base (297)..(297): a, c, t, g, unknown or other
  modified_base (341)..(341): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggacgtcctgagactctctgtgttgcgtccgatcagttcagtgactntgccatgcacgtgggtccncaggctccgaggcgaaggggctgggagtggggtgcagtcagtcnggtctgataggaataaagatactataggaaacctcggtagaacgggcctattccgtccgtcctcaagagactaattacccaaagaaccacgtagtaactactaaactaaatcgtaaactaagtttacgaagacgtaccggaggtacctcggcctactacgttaactttattacgtacgaccgtacctaacgttccgttacctacggttacgggggaacccgtaaggggtaccgtacccggttcgggtacccacccggttaccttcccg

SEQ ID NO: 410604 - DNA, 645 bp, Homo sapiens
  misc_feature: GZ8MTXP02I5SER.44.45.E01.1.454.CMB.2.raw
  modified_base (300)..(300): a, c, t, g, unknown or other
  modified_base (323)..(323): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggacgtcctgagactctcctgtgttgcgtccggactcagtttcagtgactctgccatgcactgggtccncaggctcgaggcaaggggctggngtgggtgcagtcagtctggtctgagtaggaaagtaaaagattacgtaagtacgggaaaaccttccggtaggaaacggggcctagttcccgtcccggttacctaccgaagaacgaactaaacttaccccaaaaggaacctaccgtagtaactacctaaacaaaatacgaaactaattagaagtacgaccggaggtactcggacttctacttatttacttacggtaccgacggtaccctaagtttcccgttacctacggtacgggggaacccgtaacgggggtaccgtccccggttacggtacccgtacccggttactcccccg

SEQ ID NO: 410605 - DNA, 408 bp, Homo sapiens
  misc_feature: GZ8MTXP02J3W7G.44.45.E01.1.454.CMB.2.raw
  modified_base (404)..(408): a, c, t, g, unknown or other
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagccctccaccaacgggcccatccggtcttcccccctggccgccctgctccaggagcacctccgagagcacagcggccctgggctgcctggtcaaggaccctacttcctatatactgtctgagcgggctggcaggcgcatgnnnnn

SEQ ID NO: 410606 - DNA, 554 bp, Homo sapiens
  misc_feature: GZ8MTXP02GMY54.44.45.E01.1.454.CMB.2.raw
  modified_base (159)..(159): a, c, t, g, unknown or other
  modified_base (369)..(369): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcgtggttttcncgttagctcttttaagaggtgtccagtgtcaggttcagctggtgagtctgggggagcgtggtccagcctgggacgtccctgagactctcctgtgttgcgtcggactcagtttcagtgactctgccatgcacgtgggtccgccagggcctccgaggcaaggggctggagtgggtggcagtcatctggtctgatggaagtaaacgatactanaggaaactccgtgaaagggccgtaattcctccgtactccagacgacaattccaagaaccaccgtagtatactaacaaatagaacaattagagagacgacgacgtcggctctctattacttagtacgtacgtacctactcgttcgtacgtcggtcgacggacgccgtcggtcgtaccgtcgtcccg

SEQ ID NO: 410607 - DNA, 690 bp, Homo sapiens
  misc_feature: GZ8MTXP02J25IA.44.45.E01.1.454.CMB.2.raw
  modified_base (304)..(304): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagccgtgggactcctgagactctctgtgttgcgtccggatcagtttcagtgactctgccatcgctacgtcggggtcccnccgagggcctccgaggccgaaggggctgggagtgggtgcagtcagtcgtggtctggacgtaggaaagtaaagaattcgagtacggaaacctcggtaggaacgggtcctattccgtacccgtctacccgaaggacgtaactaacgttaccgaaacgtaacctaccggttattaacttacctaaaactaaacgtacgtaaacttaagttacggaacggtacggaccggtaacggtaccgtccggtacttaccgttacgtttaacgtttacgttacggtaaccggtaaccgtacccgttaacgttaccgttaccggttaaccgggtaccgggggtaacccgtaacggggtacccgtcccggttacggtacccgtacccggttcctcccg

SEQ ID NO: 410608 - DNA, 607 bp, Homo sapiens
  misc_feature: GZ8MTXP02I75DX.44.45.E01.1.454.CMB.2.raw
  modified_base (302)..(302): a, c, t, g, unknown or other
  modified_base (355)..(355): a, c, t, g, unknown or other
  modified_base (418)..(418): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggacctcctgagactctcctgtgttgcgtccggactcagttcagtgactctgccatcgcacgtgggtcccnccaggcctaccgaggccgaaggggctgggagtgggtgcagtcattcgtggtcngatggaaattaaagatacgtagtaggaaacctcggtagaacgggcctattcctcgtctcaganacaataccaagaacacgtatactactaacaaatcgtaaactagtttagaagacgaccgaaggtacctcggtaccttactacttatttaacgttcgtaacggacgtaccccttagttaccggttaccttaacggtcggggaacccgtaggggtaccgtacccgttcgggtacctacccggtccttccccg

SEQ ID NO: 410609 - DNA, 576 bp, Homo sapiens
  misc_feature: GZ8MTXP02FZ8E5.44.45.E01.1.454.CMB.2.raw
  modified_base (515)..(515): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggacgtccctgagactctcctgtgttgcgtccggactcagtttcagtgactctgccatgccactgggtcccgccaggcctccgaggcgaaggggctgggagtggggtgcagtcatcgtggtctagagtaggaaagtaaaagatacgtaatacggaaactccgtagaacgggcctattccgtcgtctaccgagacgaactaactaccaaagaaccaccgtagtactactaaacaaatagaactagttagagacgacgagactcgctctctattacgtcgacgacncctagttcgttacgtacgtcggggaacccgagggacgtcccgtggtccaccgtcgtacccg

SEQ ID NO: 410610 - DNA, 681 bp, Homo sapiens
  misc_feature: GZ8MTXP02F6DC0.44.45.E01.1.454.CMB.2.raw
  modified_base (276)..(276): a, c, t, g, unknown or other
  modified_base (302)..(302): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggacgtccctgagactctcctgtgttgcgtcgactcagttcagtnactctgccatcgcacgtcgggtcccnccgagggcctaccgagggtaccgaaggggggtctaggggagggtggggtcgggctaaggtcagttcgtggtcgtaggaagttagggaaaagtaaaagaattacgttaagtacgggtaaaaccttccggtagggaaacggggtcctaacgtttccgtcccgttacctcccgaaggaacgaacctaaacttacccgaaagtaaaccctaccgtagtactacctaaacaaaattacgaaactaagtttagaagtacgacgaaggtaccgttcggacttcctattaagtttacgttacgtaaccgacgtaccccgtattccgttactacggtacgggggaaccgtaggggtaccgtcccgtcggtaccgtacccgtctccccg

SEQ ID NO: 410611 - DNA, 682 bp, Homo sapiens
  misc_feature: GZ8MTXP02GWYX6.44.45.E01.1.454.CMB.2.raw
  modified_base (268)..(268): a, c, t, g, unknown or other
  modified_base (276)..(276): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagccgtgggactccctgagactctcctgtgtcgcgtccgctcngttctcgngtactctgccatgccacgtgggtccggcccacgggacctcccgacggacggaacggggccggtgggagggtggggtcggggtcgaacgtcgacgttcgtccgggttcgtggaagtagggtaaaagtaaaaggtaaactaccgttaagtaaggaaaccgttacccggtagggaaggggtacccggtactttaccgtcccgtacttcccgaaacggaggaacctaaaattccccaaagaaaccgtacccgtagtaacttactaaaccaaaatagtaaacctaaatttgagaaccggtccgaaagggtactcggtcctgttaacttattacgtgttacgaccgtaccacttacgttcctacggtaccgggggctacggacggtcccgtggtcccgtacctccgtttacc

SEQ ID NO: 410612 - DNA, 652 bp, Homo sapiens
  misc_feature: GZ8MTXP02G5J0V.44.45.E01.1.454.CMB.2.raw
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggactccctgagactctcctgtgttgcgtccggactcagtttcagtgactctgccatgcacgtcgggtcccgccagggcctccgagggcgaaggggctgggagtggggtggcaggtcagttcgtggtctgtagtaggaaagtaaaagaatacgtagtacgggaaaacctcggtaggaaacgggccgtattaccgtccgtcctaccgaaggacgaactaaacttactaaacgaaacgtaccgtagtatactaaacaaatacgtaaactaaagtttcggaaagacgacccggaaggtaccgtcggtccttaccgtacgttaatttaacgttagttaccgaacgtcccctaattccggtttacctacggtacggggaacccgtaggggaccgtcccgttggtacccgtacccggttcctacccg

SEQ ID NO: 410613 - DNA, 714 bp, Homo sapiens
  misc_feature: GZ8MTXP02GWAJW.44.45.E01.1.454.CMB.2.raw
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagccgtgggactcctgagactctcctgtgttgcgtccggactctagttcagtgactctgccatgccacgtgggtcccgccaggcctccgagggcgaaggggcgtagggaggttggggtggcagtcattcgtggtctgagtaggaaagtaaagaattacgtagtaggtaaaaccgttccggtagggaaacgggtcccgtaagttcccgtcccgttaccctacccgaaggacgaaccgtaaacttacccgaaaacgaaacccgtaccgttagtaacttaaccgtaaactaaaaacgttacggtaaaacttaaaagttttacgggaaaaggtaaccggacccggtaaacgggtaccgttaccgggtacccttaccgttacttaaagtttacgtttacgtaaaccgacgtacccctaagtttcccgtttacgtaccggtacgggggaacctacgggggaccgtcccgtggtaccctacccgttccgtaccccg

SEQ ID NO: 410614 - DNA, 614 bp, Homo sapiens
  misc_feature: GZ8MTXP02JD1MJ.44.45.E01.1.454.CMB.2.raw
  modified_base (303)..(303): a, c, t, g, unknown or other
  modified_base (359)..(359): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggactccctgacgactctcctgtgttgcgtccgactcagtttcagtgactctgccatgcacgtcgggtcccnccagggcctccgaggccgaaggggctgggaggtggggtggcagtcagtcgtggtcngagtaggaaataaaacgatactagtaggaaactcgtaggaacgggcctattctccgtctaccgagacgaactaacttaccaaagaacctaccgtagtaatactaaacaaatagtaaactaagttagaagacggaccgaggtacgtacggcttctacttatttattacgtacgtaaccgtccctaagttccgttacctacggttcgggggaaccgtaacggggccgtcccgtacggtccctaccggtccctacccg

SEQ ID NO: 410615 - DNA, 654 bp, Homo sapiens
  misc_feature: GZ8MTXP02IQCEW.44.45.E01.1.454.CMB.2.raw
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctggggttttcctcgttgctctttaagaggtgtccagtgtcaggttcagctggtggagtcgtgggggagcgtggtccagcctgggacctcctgagctctctgtgtgcgtcgactcagttcagtgactctcgccatgcacgtcggggtccgccagggcctccgagggtaccgaaggggctagggaggtggggtggcagtcagtcgtggtctagagtagggtaaagtaaagaatactaagtacggaaaccttcggtaggaaacgggtccgtaattccgtccgtactccgaagacgaaactaacttacccgaaacgaaccgtacgttacgtaacttactaaactaaatacgtaaaactaagtttagaacgaacgtaccggagtaacgtcgggtactcttacgttaatttacgttacggtaacgtactaccctatttaccgtacgttacggtacggggaaccgtaaggggtaccgtaccccgttgggtacccttacccggttcttacccg

SEQ ID NO: 410616 - DNA, 645 bp, Homo sapiens
  misc_feature: GZ8MTXP02IDAV6.44.45.E01.1.454.CMB.2.raw
  modified_base (356)..(356): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctgggtggagtcgtgggggagcgtggtccaggccgtgggaccgtcctgagactctcctgtgtgcgtccgactcagtttcagtgactctgccatgcacgtgggtccgcacggcctccgaggcgaaggggctgggagtggggtgctagtcagtcgtggtcngataggaaagtaaagaattacgtagtaacgggaaaacctccgtagggaaacgggtcctaactttcccgtccgtaccttaccgaagacgaactaaaacgttacccaaaacgaaacctaaccgtagtaacttacgtaaacctaaaagtacgtaaactaagtttagaacgtacggaccgacggtacgtacggtctcgttactacgtttattagtacgacgtacccacgttccgttacttaccggtcggggaaccgtacgggaccgtccgtacggtccgtacccgtctacccg

SEQ ID NO: 410617 - DNA, 641 bp, Homo sapiens
  misc_feature: GZ8MTXP02G2PIS.44.45.E01.1.454.CMB.2.raw
  modified_base (433)..(433): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccaggcctgggactcctgagctctctgtgttgcgtccggactcagttcagtgactctgccatcgcacgtgggtcccgccgagggcctccgaggccaaggggctggaggtgggtggcagtcatcgtggtctgagtaggaaagtaaagaatacgtagtacggaaactccgtagaaacgggtcctaacgttcctacccgtcctacccgaaganaaccgtaaattacccaaagtaaaccctaccgtagtaactactaaacctaaaatacgtaaaactaaagtttaggaagaacgaccgaagggaactccggcttacgtcttaaatttagttacgttaaccgaacgtcccctaacgttccgttacgtaacgtcggggaacccgtaggggaccgtacccgtggtaccctacccggtctaccccg

SEQ ID NO: 410618 - DNA, 577 bp, Homo sapiens
  misc_feature: GZ8MTXP02IEA6J.44.45.E01.1.454.CMB.2.raw
  modified_base (268)..(268): a, c, t, g, unknown or other
  modified_base (300)..(300): a, c, t, g, unknown or other
  modified_base (506)..(506): a, c, t, g, unknown or other
  modified_base (551)..(551): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggactccctgagactctcctgtgttgcgtccggactnagtttcagtgactctgccatgcactgggtccnccaggctccgaggcaaggggctgggagtgggtgcagtcagtctggtctgataggaaagtaaagattactaagtacggaaaaccttccggtagaaacgggggtcctaagttcccttccggtccttacccgaagacgtaacaaactttaccgaaagaaaccaccggtataactactaacaaatagaaactaatttagagagcgagacncgatctacttattatcgtacgctaccactcgtctactcggggccngggactccgtggtccaccgttctccg

SEQ ID NO: 410619 - DNA, 460 bp, Homo sapiens
  misc_feature: GZ8MTXP02GANHG.44.45.E01.1.454.CMB.2.raw
  modified_base (450)..(460): a, c, t, g, unknown or other
tcagacagtatatacacgaccggtgctcgatttagtgagtcagtaagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagaggacggggggcaacgtggctcgaccccgtggggccagggaaccctggtccaccgtctcctcacgcctccaccgaagggccccatccggtccttcccccctggccacccctcctccaagcgccacctcgtcgggggcacgacggcccggccctggggctcgcctggtcaggactacttcctatatactgtctgagcggctggcaaggcgcatagnnnnnnnnnnn

SEQ ID NO: 410620 - DNA, 650 bp, Homo sapiens
  misc_feature: GZ8MTXP02GXMZ0.44.45.E01.1.454.CMB.2.raw
  modified_base (302)..(302): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagccgtgggactccctgagactctcctgtgttcgcgtccggatcagtttcagtgactctgccatgcacgtcgggccnccaggcctccgaggcgaaggggctgggagtggggtgcagtcagtcgtcggtctgataggaaataaagatacgtagtacggaaactcgtaggaacggcctattccgtcgtcctacgaagacgaactaaattccaaacgaaccgtaaccgtagtaactacctaaacaaatacgtaaactaattagagtaacgaccgagtaccgtcggtacctacgttacttaagtttaacgttacggtaaccgtaaccggtaccctaacgtttaccgttacccgttaacggttccgggggaaccgttaacggggaccgttccccggttacggtacccgtaacccggttccctttaccccg

SEQ ID NO: 410621 - DNA, 605 bp, Homo sapiens
  misc_feature: GZ8MTXP02IVPJ2.44.45.E01.1.454.CMB.2.raw
  modified_base (302)..(302): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggacgtccctgagctctcctgtgttgcgtccggatcagtttcagtgactctgccatcgcacgtcgggtccnccaggcctccgaggcgaaggggctgggaggtgggtgcagtcagtcgtggtctgataggaaataaagaatacgtagtaggaaaccttccggtaggaacgggcctattcctccgtctccagagactaacttaccaaagaaccaccgtatactactaaacaaatagaactaagttagaagacgaccgaggactcggcttactacgttaattacgttacgtacgtacgtccctacttccgttaccgttaccggttggggaaccgtacggggaccgtacccgtcggtaccctaccgttccgttacccg

SEQ ID NO: 410622 - DNA, 631 bp, Homo sapiens
  misc_feature: GZ8MTXP02ITTC2.44.45.E01.1.454.CMB.2.raw
  modified_base (302)..(302): a, c, t, g, unknown or other
  modified_base (605)..(605): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggaggcgtggtccagccgtgggacctcctgagactctcctgtgttgcgtccgactcagtttcagtgactctgccatcgcacgtggtccnccagggcctccgaggcgaaggggtctggaggtgggtgcagtcagtcgtggtctgagttaggaaagttaaagaattacgtagtacgggtaaaccttcggtagaacggggcctaattccgtcccgttctaccgagacgtaacctaacttacccgaaacgtaaccaccgtagtaactactaactaaagtacgtaaactaagtttaggaacgtacgaccggaggacgtcggacttactactagttacgttagaccgtacgtaccctacgttaccgttccgtaacggtcggggccgaacggggtaccncccggtaggtccctaccgtctccccg

SEQ ID NO: 410623 - DNA, 708 bp, Homo sapiens
  misc_feature: GZ8MTXP02GOBBV.44.45.E01.1.454.CMB.2.raw
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtctgggggaggcgtggtccagcctgggacgtccctgagactctcctgtgttgcgtccggactcagtttcagtgactctgccatgcacgtgggtcccgccaggcctccgaggcaaggggctgggagtggggtgcagtcatcgtggtctgagtaggaaagtaaaacgaattacgtaagtacggaaaaccttccggtagggaaacggggtcccgtaagtttcccgtacccgttacctacccgaaaggtaacgaaacctaaacgttacccgaaaacgtaaacccgtaacccggttagttaaacttaacctaaacctaaaattacgtaaaactaatttacggaagaaccgaccggaaggtaccgtacgggtacttaccgttacttaagtttacgtttacggtaacgaaccggtacccctaaacgtttccgttaccgttaaccgggtccgggggaaccgtaacgggggacccgtccccgtcggtacccgtacccgttacccttccccg

SEQ ID NO: 410624 - DNA, 578 bp, Homo sapiens
  misc_feature: GZ8MTXP02GU0QJ.44.45.E01.1.454.CMB.2.raw
  modified_base (274)..(274): a, c, t, g, unknown or other
  modified_base (299)..(299): a, c, t, g, unknown or other
  modified_base (350)..(350): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggactccctgagctctcctgtgtgcgtccgactcagttcagtnactctgccatgcacgtggggtcccnccagggcctccgaggcaaggggctgggagtggggtgcagtcatcgtggtcngatacggaaataaagatcgtagtaggaaactccgtagaacgggcctattctccgtctacagacgactaataccaagaacacgtagtactactaacaaatacgaaactaatttagaagtacgaccgaggacgtcggctacgtactatttagttcgtacgacgtcctacgttccgttacgtacggtcggggaaccgtacgggacgtccgtcggtcctaccggtcctcccg

SEQ ID NO: 410625 - DNA, 551 bp, Homo sapiens
  misc_feature: GZ8MTXP02H057N.44.45.E01.1.454.CMB.2.raw
  modified_base (276)..(276): a, c, t, g, unknown or other
  modified_base (295)..(295): a, c, t, g, unknown or other
tcagacagtatatacacgaccggtgctcgatttagtgagtcagtaagggaaagggctgggagaggagcccagcactagaagtcggcggtgtttccattcggtgatcagcactgaacacagaggactcaccatggagtttggctgagctgggttttcctcgttgctcttttaagaggtgtccagtgtcaggttcagctggtggagtcgtgggggagcgtggtccagcctgggactcctgagctctctgtgtgcgtccggatcagtttcagtgactcngccatgcacgtgggtcccnccaggcctccgaggcgaaggggctgggagtggggtgcagtcatcgtggtctagagtaggaaataaagatctagtaggaaacctcgtagaacgggcctattcctccgtctccagagactaacttaccaagtaacaccgtagtaactactaaacaaatagaaactaattgaagacgacgaagctcggctactcttattactgtacgacgtccattcgtctacgtcgggccgagggacgcccgtgtcctaccgtctccg

SEQ ID NO: 410626 - DNA, 561 bp, Homo sapiens
  misc_feature: GZ8MTXP02IFT9L.44.45.E01.1.454.CMB.2.raw
  modified_base (159)..(159): a, c, t, g, unknown or other
  modified_base (175)..(175): a, c, t, g, unknown or other
  modified_base (301)..(301): a, c, t, g, unknown or other
  modified_base (401)..(401): a, c, t, g, unknown or other
  modified_base (410)..(410): a, c, t, g, unknown or other
  modified_base (492)..(492): a, c, t, g, unknown or other
tcagacagtatatacacgaccggtgctcgatttagtgagtcagtaagggaaagggctgggacaggagcccagcactagaagtcggcggtgtttccattcggtgatcagcactgaacacagaggactcaccatggagtttgggctgagctgggttttccncgttgctcttttaagnggtgtccagtgtcaggttcagctggtggagtcgtggggggagcgtggtccaggcctgggacctcctgagctctcctgtgttgccgtccggactcagtttcagtgactctgccatgcactgggtccnccaggctccaggcaaggggctggagtggggtggcagtcagtctggtctgataggaagtaaaagattacgataggaaactccgtagacgggcctatactcnctaccaganacaattccaagacaccgtatactactaacaaatgaaactaattagaagagccgagactcggctctattattattcggtaacncgaccctagttccgttacgtacgtcgggggaaccaacggggtactacccgtgtccctaccggtctcccg

SEQ ID NO: 410627 - DNA, 672 bp, Homo sapiens
  misc_feature: GZ8MTXP02HCCLY.44.45.E01.1.454.CMB.2.raw
  modified_base (298)..(298): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggactcctgagactctctgtgttgcgtcgactcagttcagtgactctgccatcgcacgtgggtcccnccaggcctccgaggcgaaggggctgggagtggggtgctagtcagtcgtggtctgagtaggaaacgtaaagtaatccgtaagtacggaaaccgtccggtaggaacggggtcctagttccgtaccgtcctaccgaagacgaactaaacgttacccgaaagtaaccgtaccgtacgttaactacctaaactaaaattacgtaaaactaagtttacgaacgtacggaccggaacggtacgtaccggtccttacgttacgtttaactttagttacgtaccgtaacgtaccccgtagttacccgtttaccgtaaccggttccgggggaaccgtacggggtaccgtacccggttcggtacccgtacccggttcctaccccg

SEQ ID NO: 410628 - DNA, 615 bp, Homo sapiens
  misc_feature: GZ8MTXP02F3EMF.44.45.E01.1.454.CMB.2.raw
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggactccctgagactctcctgtgttgcgtccggactcagtttcagtgactctgccatgccacgtgggtccgccagggcctccgagggccaaggggctgggagtggggtggcagtcatctggtctgatggaataaagatacataggaaactccgtagaagggcctattctccgtctccgagacgaactaacttcccgaaagaaaccgtaccgtagtaactactaaaactaaagtacgaaataagttacggaagaacggaccgaacggtacgtaccggtctacttacttaagtttacgttacgtacgaccgtaccctaacgttcgttaccgacgggttacgggaaccggacgggaccgtccggtacgtccctacccgtctaccccg

SEQ ID NO: 410629 - DNA, 650 bp, Homo sapiens
  misc_feature: GZ8MTXP02HD2KR.44.45.E01.1.454.CMB.2.raw
  modified_base (308)..(308): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagctggtggagtcgtgggggagcgtggtccagccgtgggaccgtcctgagactctcctgtgttgcgtccggactctagtttcagtgactctgccatgcacgtcgggtcccnccgaggcctaccgaggcggaaggggcgtgggaggtggggtggctagtccatcgtcggtctgagtagggaaagtaaagaatacgtaagtacggaaaaccgtcgtaaggaacgggtcctaacttccgtccgtcctaccgagacgaaccgtaaacttaccgaaaacgtaaccgtaaccgttacgtaacttacctaaacaaaagtacgaaattaagtttagaagaacgaccggaggtacctacggtacttacctacttaactttaacgttcgtacgtacgtaccctacgttccgtacgtacggtcgggaacgacgggaccgtccgtacggtcctaccgtcctcccg

SEQ ID NO: 410630 - DNA, 634 bp, Homo sapiens
  misc_feature: GZ8MTXP02G1KRD.44.45.E01.1.454.CMB.2.raw
  modified_base (276)..(276): a, c, t, g, unknown or other
  modified_base (300)..(300): a, c, t, g, unknown or other
  modified_base (342)..(342): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggactccctgagactctcctgtgttgcgtccgactcagttcagtnactctgccatgcacgtcgggtccnccagggcctccgaagggccgaaagggggctgggagttggggnggcagtccatcgtggtctgatagggaaaataaaagaatacgtaatagggaaaacctcggtagaaacgggcctaattcctccgtctaccaagagaactaaacttacccaaagaaaccaccgtagtaactaactaaacaaaatagaaactaatttagaagaacgaccgaaggactcggactactacttaatttaagttacgttaacgacgtaccctaaagttccgttacgtacggttacggggaaccgtaacggggtaccgacccgttcgggtacctaaccccggtctaccccg

SEQ ID NO: 410631 - DNA, 633 bp, Homo sapiens
  misc_feature: GZ8MTXP02JX8LH.44.45.E01.1.454.CMB.2.raw
  modified_base (299)..(299): a, c, t, g, unknown or other
  modified_base (349)..(349): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggactccctgagactctcctgtgtgcgtccggactcagttcagtgactctgccatgcacgtgggtccnccaggcctcgaggcgaaggggctgggagtgggtggcagtcagtctggtcngtagtagggaaagtaaagatacgtaagtaggaaaacctccgtaggaacgggccgtaagttcctccgtactccgaagacaactaacttaccaaagaacctaccgtagtaactactaaacaaatagaaactaatttaggaagtacggaccggaaggtacgtcggaccttcgtacgttatttacgttacggtaccggaccgttaccgtacgttaccgtaaccgttccggggtaccgggaaccggacgggtacccgtccggttaccggtaccgtcccggtacctcccg

SEQ ID NO: 410632 - DNA, 675 bp, Homo sapiens
  misc_feature: GZ8MTXP02GBY4W.44.45.E01.1.454.CMB.2.raw
  modified_base (275)..(275): a, c, t, g, unknown or other
  modified_base (299)..(299): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggactcctgagactctcctgtgtgcgtccgactcagtttcagtnactctgccatcgcactcgggtccnccgaggccctccgagggcgaaggggtctaggggacggtggggtcgcaggtcagtcgtggtctggataggaaagtaaagactacgtagtacggtaaactccgtaggaacggggtcctaagttccgtaccgtccgtaccgaagaacgtaacctaaacttacccgaaaacgaaaccgtaccgtacgtaactacctaaacctaaagtacgtaaactatttaggaacgtaacggacccgtagggacctacgggaccttacgttacgttagtttaagttcggtaacgtacgtaccccttagttaccgttaccgtaaccggttacggggaacccgtaacgggggtaccgtccccggtacgtaccgtacccggttaccctcccg

SEQ ID NO: 410633 - DNA, 560 bp, Homo sapiens
  misc_feature: GZ8MTXP02HZV2V.44.45.E01.1.454.CMB.2.raw
  modified_base (297)..(297): a, c, t, g, unknown or other
  modified_base (365)..(365): a, c, t, g, unknown or other
  modified_base (434)..(434): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgcttcttttaagaggtgtccagtgtcaggttcagctggtggagtcgtggggagcgtggtccagcctgggactcctgagactctcctgtgttgcgtccggatcagtttcagtgactctgccatgcacgtggccnccaggctccaggcaaggggctggagtgggtgcagtcatctggctgataggaaataaagaatacgtaanaggaaactccgtaggaaacgggcctattcctccgctaccagtagactaattaccaaagtaaccaccgtntaactacaacaaatagaaactaattagagagacgagactcggctactatattatacgtacacgtcccaacgttccttacgtacgtcgggccgacgggacgtcccgtaggtcccaccggttcctccg

SEQ ID NO: 410634 - DNA, 630 bp, Homo sapiens
  misc_feature: GZ8MTXP02J1NCJ.44.45.E01.1.454.CMB.2.raw
  modified_base (301)..(301): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggacgtcctgagactctctgtgttgcgtccgactcagttcagtgactctgccatgccacgtcgggtcccnccaggcctccgaggccgaaggggctgggaggtgggtggcagtcatcgtggtctgagtaggaaataaagaatcgtaagtacggaaacctccgtaggaacgggtcctattcccgtacccgtacccgaacgaacgaacctaaacttacccgaaacgaaaccgtaaccgtacgtactactaaacaaatagaaactaatttagagtacgaccgaggtacgtcggtcttacgtacttaagttacttacgtacgtacgaccctacgttaccgttacgtacggtcggggtaccgaacggggtaccgtcccgtcggtaccgtcccgtcctcccgtccg

SEQ ID NO: 410635 - DNA, 572 bp, Homo sapiens
  misc_feature: GZ8MTXP02G6S32.44.45.E01.1.454.CMB.2.raw
  modified_base (300)..(300): a, c, t, g, unknown or other
  modified_base (498)..(498): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggactccctgacgactctcctgtgtgcgtccggactcagttcagtgactctgccatgcacgtgggtccnccagggcctccaggcgaaggggctgggaggtgggtggcagtcatctgggtctgagtaggaaagtaaagatactagaggaaaccttcgtagaacggggcctagttcctccgtctaccgaagacgaacaattaccaaacgaacgtaccgtagtactactaacaaatcgaaactattagagacgaccgagacgtcgctctntacttattcgtacgacgtaccattaccgttcgtacgtcggggccgtaggaccgtccgtgtcctaccgtcgtccg

SEQ ID NO: 410636 - DNA, 543 bp, Homo sapiens
  misc_feature: GZ8MTXP02FX9OW.44.45.E01.1.454.CMB.2.raw
  modified_base (299)..(299): a, c, t, g, unknown or other
  modified_base (345)..(345): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggactccctgagactctcctgtgttgcgtccgactcagtttcagtgactctgccatgcactgggtccnccaggctccgaggcaaggggctggagtgggtgcagtcatctggtcngatggaataaagaatcatggaaactccgtagaacggggcctattctccgtctccagacgacaattaccaaagaacaccgtagtatactaacaaatgaaactatttagagacgccgagactcggctactctattatgtacgacgccctatcgttactacgtcggggccgagggacgtcccgtggtccaccggtctcccg

SEQ ID NO: 410637 - DNA, 638 bp, Homo sapiens
  misc_feature: GZ8MTXP02IN3U1.44.45.E01.1.454.CMB.2.raw
  modified_base (287)..(287): a, c, t, g, unknown or other
  modified_base (299)..(299): a, c, t, g, unknown or other
  modified_base (323)..(323): a, c, t, g, unknown or other
  modified_base (334)..(334): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcgtggttttcgcgttaggctcttttaagaggtgtccagtgtcaggttcagctggtggagtcgtgggggagcgtggtccagcctgggacgtcctgagctctctgtgtgcgtcgactcagtttcagtgactctgccatgcnctcggtccgccncgctccgacgcgaagggcgtgggnggtggtggcgngtctgtcgtcgtgtgtagtaggtaaagtaaagaatactagtacgtaacgtacgtacgtacggacgtacgttcgtccgtcgtacgacgacgtaactaacgtaaccgaacgaacgtaccgtacgtactaactaaactaaacgtaacgtaaacgtaacgttagtaacgacgacggtacggtacgtacggtacgtacttacttacgtttacgttacggtacgtacgtaccgttacgttacgttaccgtaccggtacgggtaacggtacgggtaccggtaccggtaccggtacccgtccgttccgtccg

SEQ ID NO: 410638 - DNA, 573 bp, Homo sapiens
  misc_feature: GZ8MTXP02I1DL9.44.45.E01.1.454.CMB.2.raw
  modified_base (299)..(299): a, c, t, g, unknown or other
  modified_base (331)..(331): a, c, t, g, unknown or other
  modified_base (391)..(391): a, c, t, g, unknown or other
  modified_base (401)..(401): a, c, t, g, unknown or other
  modified_base (437)..(437): a, c, t, g, unknown or other
tcagacagtatatacacgaccggtgctcgatttagtgagtcagtaagggaagggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggaggcgtggtccagcctgggactccctgagactctcctgtgttgcgtcggactcagttcagtgactctgccatgcactgggtccnccaggctccgaggcgaaggggctggagtgggngcagtcagtctggtctgatggaaataaagatactataggaaactcgtagaacggctatcncgtctcaganacaacttccaaagacaccgtagtataccaactaaangaaactaatttagaagtacgaccggaagaacgtcggtctactacgtattaagttcgttaacgacgtacccgtaattccgttacacggttcggggaacccgtaggggaccgtccgtcggtacctaccgtcctacccg

SEQ ID NO: 410639 - DNA, 562 bp, Homo sapiens
  misc_feature: GZ8MTXP02GDBCH.44.45.E01.1.454.CMB.2.raw
  modified_base (356)..(356): a, c, t, g, unknown or other
  modified_base (370)..(370): a, c, t, g, unknown or other
  modified_base (415)..(415): a, c, t, g, unknown or other
  modified_base (424)..(424): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgctcttttaagaggtgtccagtgtcaggttcagctggtggagtcgtgggggagcgtggtccagcctgggactccctgagctctcctgtgttgcgtccggactcagtttcagtgactctgccatgcacgtgggtccgccagggcctcccgaggccgaagggggctgggagtgggtggcagtcatcgtggtcngataggaagtaaanaatactagtagaaactccgtagaacgggctatctcgtctccaganacatccaanaacacgtatatactaacaaatagaaactaattaggaagtagaccgaggactcggctcgtcttattattgtacgacgtaccctattccgttactacgtcggggccgtagggacgtccgtcggtccgtaccgtcctcccg

SEQ ID NO: 410640 - DNA, 646 bp, Homo sapiens
  misc_feature: GZ8MTXP02INE6Y.44.45.E01.1.454.CMB.2.raw
  modified_base (302)..(302): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagctggtggagtcgtgggggagcgtggtccagccgtgggactcctgagactctcctgtgttgcgtccgatcagtttcagtgactctgccatgcacgtgggtcccncaggcctccgaggacgaaggggctgggagtggggtcgcagtcagtctggtctgataggaaagtaaagatactatacggaaactccggtagaacgggtcctaatcctccgtctacccgagaacgactaaacgttacccgaaaagaacccgtaaccgtagttaaacttacctaaaactaaaagtacggtaaaactaaagtttagaacgtaacggacccgaagggtacctccggacttccgtacttaagtttattacgacgtacgtacccctaagtttcccgttcgttaacggtcggggtccgaaacgggtccgtaccccgtaggtccccgaccggtttcctccccg

SEQ ID NO: 410641 - DNA, 556 bp, Homo sapiens
  misc_feature: GZ8MTXP02I2NNK.44.45.E01.1.454.CMB.2.raw
  modified_base (300)..(300): a, c, t, g, unknown or other
  modified_base (339)..(339): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggacgtccctgagactctcctgtgttgcgtccgactcagtttcagtgactctgccatgcactgggtccnccaggctccaggcaaggggctggagtggtgcagtcatcnggtctgatggaataaagatacgtatcggaaactccgtagaagggcctattctcgtctccagagacaattccaagaacaccgtagtatactaacaaatgaactaatttgaagacgccgaggacgtcggcttactcgtattacttgtaacgacgccctaattccgttactacgtcggggaaccaggggtacgtcccgtggtaccctaccggttctcccg

SEQ ID NO: 410642 - DNA, 628 bp, Homo sapiens
  misc_feature: GZ8MTXP02FJMZI.44.45.E01.1.454.CMB.2.raw
  modified_base (298)..(298): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtgagtcgtgggggagcgtggtccagccgtgggactcctgagactctcctgtgttgcgtcgactcagttcagtgactctgccatgcacgtgggtcccncaggcctccgaggcaaggggctgggaggtggggtggcaggtcagtcgtggtctagatagggaaataaagaattactagtacggtaaacctccggtagaacggggtcctaagtttcccgtaccgtaccgtaccgaaagacgaacctaaacttaccaaacgaacctaccgtagtactactaaacaaatacgtaaactattaggacgacgaccgaggacgtcggcctacttacttaattacttacgtaacggtaacgacccttacttaccgtttacgtaacggtcggggaaccgaacgggtaccgtcccgttcgtcccgtacccgtcctcccg

SEQ ID NO: 410643 - DNA, 628 bp, Homo sapiens
  misc_feature: GZ8MTXP02FOOJR.44.45.E01.1.454.CMB.2.raw
  modified_base (304)..(304): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagccgtgggacgtcctgagactctcctgtgttgcgtccggactcagtttcagtgactctgccatcgcacgtgggtcccnccaggcctaccgaggccgaagggggctgggaggtggggtggccagtcagttcgtgggtctggatagggaaataaagaattacgtagtacgggaaaacctccggtaggaaacgggtccctattccgtcccgtcctaccgaagaacgaactaacttacccaaagaaccctaccgtataactacctaaacaaatacgaaactaattgaagacggacgaggtactacgctacgtcttaattacttacgtacacgtaccctacgttccgttacgtacggtacggggaacgacggggactccccgtaggtaccctaccggttacctcccg

SEQ ID NO: 410644 - DNA, 439 bp, Homo sapiens
  misc_feature: GZ8MTXP02FGTD3.44.45.E01.1.454.CMB.2.raw
  modified_base (279)..(279): a, c, t, g, unknown or other
  modified_base (436)..(439): a, c, t, g, unknown or other
tcagacagtatatacacgaccggtgctcgatttagtgagtcagtaaggggaagggactggagtggattgggcgcatctataacagtggcagcaccaactacaacccccgccctcaagagtcgagtcaccatgtcactagacaggtccaagaaccagttctccctgaaaattgacttctgtgaccgccgcggacacggccgtatattattgtgcgagagattcctatcgatacagtagagacggggggcaactggctcgacccgtggggccagggacccnggtcaccgtctcctcagcctccaccaagggcccatcggtctccccctggccaccctcctccaagacgcacctctgggggcacgagcccggccctggggctgcctggtcacggctacttcctatatactgtctgagcgggctggcaaggcgcgatagnnnn

SEQ ID NO: 410645 - DNA, 606 bp, Homo sapiens
  misc_feature: GZ8MTXP02HR5H4.44.45.E01.1.454.CMB.2.raw
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggaggcgtggtccagcctgggacgtccctgagactctcctgtgttgcgtccggactcagtttcagtgactctgccatgcactgggtccgccaggctccaggcgaaggggctggagtggggtggcagtcatcgtggtctgagtaggaagtaaagatactataggaaacctccgtagaacggggcctattccgtaccgtcctaccgagacgaactaacttaccaaacgaaccaccgtagtaactactaacaaatagaaactaagtttagagagaccgaaggactcggaccttcgtacttaatttacttacggtacgaacgtccccgtaattccgttacctacggtcggggtaacccgaaggggacgtccccgtggtacccaccggttcctacccg

SEQ ID NO: 410646 - DNA, 580 bp, Homo sapiens
  misc_feature: GZ8MTXP02I28AB.44.45.E01.1.454.CMB.2.raw
  modified_base (303)..(303): a, c, t, g, unknown or other
  modified_base (421)..(421): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagccgtgggacgtcctgagactctcctgtgtgcgtccggactctagtttcagtgactctgccatgcacgtgggtcccnccaggcctccgaggcgaaggggctgggaggtggggtgctagtcagtcgtggtctgataggaaagtaaagatacgtagtacggaaactccgtagaacgggctattctcgtctacgaganactataccaagacacgtagtactactaaactaaatacgtaataattgaagacgacgagacgtcgctactctattactcgtacgacgccctacgtccgttacgtacggtacggggccgacgggtaccgtcccgtacggtacccgtacccgttcgtacccg

SEQ ID NO: 410647 - DNA, 554 bp, Homo sapiens
  misc_feature: GZ8MTXP02I4CBR.44.45.E01.1.454.CMB.2.raw
  modified_base (160)..(160): a, c, t, g, unknown or other
  modified_base (374)..(374): a, c, t, g, unknown or other
  modified_base (378)..(378): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttccncgttgctcttttaagaggtgtccagtgtcaggtgaagctggtggagtcgtgggggagcgtggtccagcctgggagtccctgagactctcctgtgtagcgtctggattcaccttcaactagacatggcatgcacgtgggtccccgaggctccgaggcaaggggctgggagtgggtcggctacttatgtggtatgaatagggaattaaattaaatnttangttaagacttccgagaacggggcctattcaccatcctaccagacactaacgttacgaaagacactacgtatatacgtagaaatgaaactacgctagagacgacggagacacggtctacgtactacgtacgtgtacgacgaggagaaggtcgggcttacggagtactacgaagtacg

SEQ ID NO: 410648 - DNA, 574 bp, Homo sapiens
  misc_feature: GZ8MTXP02FFMF6.44.45.E01.1.454.CMB.2.raw
  modified_base (302)..(302): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtctgggggagcgtggtccagcctgggacgtccctgagactctcctgtgttgcgtcggactcagtttcagtgactctgcccatgcactggggtcccnccaggcctccgaggcgaaggggctggggagtggggtggcagcagtctggtctgatgggaaagtaaagaatactagtaggaaaactccgtagaaacgggccctaattccgtcccgtctacccagagaactaacttaccaaagaaaccaccgtagtaactactaacaaatagaaactaatttagagacgaccgaggactcggctcgtctattattgtacgacgcccattccgttctacgtggggccgagggacgcccgtggtccaccgtctccc

SEQ ID NO: 410649 - DNA, 706 bp, Homo sapiens
  misc_feature: GZ8MTXP02HQ5Y7.44.45.E01.1.454.CMB.2.raw
  modified_base (177)..(177): a, c, t, g, unknown or other
  modified_base (303)..(303): a, c, t, g, unknown or other
  modified_base (339)..(339): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgcttcttttaagnggtgtccagtgtcaggttcagctggtggagtcgtgggggagcgtggtccagcctgggacctccctgagctctcctgtgttgcgtccgatcagttcagtgactctgccatcgcctacgtcgggtccnccagggcctccgaggccgaggggctggaggttgggngcagtcactcgtggtctagtagtacggtaaagtaaaagattacgtagttaacggaaacttccgggtagggaaacggggtcctagttcccgtaccgtaccctaccgaacggtacgtaaaccgtaaacttacccaaaacggtaaaccctaaccggttacgttaacttaacctaaactaaaagttaaccgtaaaataaatttagggaacgtaacggaccggtaacgggaccttcgggtaccttacgttaccttaagtttaacgttacggttaacgtaacccgtaccttaacgttaccgttaccgtttaacggacgggggtaacccgaaggggtaccggtcccgtcggtacccgtacccggtttctccccg

SEQ ID NO: 410650 - DNA, 598 bp, Homo sapiens
  misc_feature: GZ8MTXP02HOK70.44.45.E01.1.454.CMB.2.raw
  modified_base (308)..(308): a, c, t, g, unknown or other
  modified_base (345)..(345): a, c, t, g, unknown or other
  modified_base (522)..(522): a, c, t, g, unknown or other
  modified_base (530)..(530): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttggctgagcttgggttttcctcgttgcttcttttaagaggtgtccagtgtcaggttcagctggtggagtcgtgggggagcgtggtccaggccgtgggacctcctgacgactctctgtgtgccgtcgactctagtttcagtgactctgccatcgctacgtcgggtacccnccgaggcctccgaggcgaaggggctgggaggtggggngcagtcatcgtggtctagagtaggaaagtaaagatactagtaggtaaacctcggtagacggtctacttacctccgtctacagactactaacttaccaaacgactaccgtagtactaactaataaatacgtaactaagttcgaagacgacggagtacgtcgacttcgtacttacgttnttacgacncgtacctataccgttcgtacgtcgggaaccgtacgggtacctccggtacgtccgaccgttcctacccg

SEQ ID NO: 410651 - DNA, 630 bp, Homo sapiens
  misc_feature: GZ8MTXP02GXU1K.44.45.E01.1.454.CMB.2.raw
  modified_base (307)..(307): a, c, t, g, unknown or other
  modified_base (465)..(465): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagctggtggagtcgtgggggagcgtggtccaggccgtgggaccgtcctgagactctctgtgttgcgtccgatctagttcagtgactctgccatcgctacgtcgggtcccnccgaggcctccgagggcgaaggggtctagggaggtggggtggcaggtctagtcgtagggtctgaagtacggaaaagtaaaagaattacgtaagacgggtaaacctcggaggaacgggtcctattcccgtacgtctacagagaactataccaagtaacncgtatatacctaagaaactgtaaactagttgaacgacggacccggagtacccgtcggtcctagttacgttaattagtttacggaccgtacgtaccccgtattcccgttacgttaacggcgggggaacctacggggctcccggttcggccttaccggtccctaccg

SEQ ID NO: 410652 - DNA, 642 bp, Homo sapiens
  misc_feature: GZ8MTXP02G7LVA.44.45.E01.1.454.CMB.2.raw
  modified_base (160)..(160): a, c, t, g, unknown or other
  modified_base (300)..(300): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcgtgggtttccncgttagctctttaagaggtgtccagtgtcaggttcagctggtggagtcgtgggggagcgtggtccagcctgggactccctgagactctcctgtgttgcgtccggatcagtttcagtgactctgccatgcacgtgggcccncaggcctccgaggcgaaggggctgggacggtggggtggcaggtcagttctggtctgataggaaagtaaagatggatagacggtaaacctcggaggaaacgggtcctattccgtaccgtctcgaagacgaactaacttaccgaaacgaaaccgaccgtagttaactacctaaaactaaattacgaaaacttaaagtttacggaaagacggacggaacgggtactacggtctaccggttacttaacgtttactaggtaaaccgcgtacccctaagttccgttcgttaacggtccgggggaaccgtaacgggggccctaccgggttacgccggtttaacccgtcc

SEQ ID NO: 410653 - DNA, 601 bp, Homo sapiens
  misc_feature: GZ8MTXP02JYBJB.44.45.E01.1.454.CMB.2.raw
  modified_base (176)..(176): a, c, t, g, unknown or other
  modified_base (300)..(300): a, c, t, g, unknown or other
  modified_base (351)..(351): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagnggtgtccagtgtcaggttcagctggtggagtcgtgggggagcgtggtccagcctgggacctcctgagctctctgtgttgcgtccggatcagtttcagtgactctgccatcgcacgtcgggtccnccaggcctccgaggcaaggggtctgggaggtggggtgcgtagtccattcgnggtctgattagggaataaagaatactaagtaggaaacctcgtaggaacgggcctattcctccgtctcgagagacatccaagacacgtatatactaacaaatagaaactattacgaagacgtaccggaaggaccgtcggccttcgtacttaagtttagttacggtaccgaccgtcctacgttccgttaccgtacggtcgggggaaccgacggggtaccgtcccggtggtacccgacccggttcctaccccg

SEQ ID NO: 410654 - DNA, 670 bp, Homo sapiens
  misc_feature: GZ8MTXP02I4A2G.44.45.E01.1.454.CMB.2.raw
  modified_base (302)..(302): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagctggtggagtcgtgggggagcgtggtccagccgtgggacctcctgagctctcctgtgtgccgtccgactcagtttcagtgactctgccatgctacgtggcccncaggcctcgaggcgaaggggctgggaggtgggtgcagtcagtcgtggtctgagtaggaaagtaaagacttacgtagtacggaaaccttcggtaaggaacgggtcctagttcctccgtctaccgaagacgtaactaacttaccaaacgtaacctaccgtagtaacttaactaaacctaaagtacgtaaactaagtttaggaacgacgaccggtaacggtaccgtacggtccttacgttaccgtttaatttaacgttacgtaaccgtaccgtacccttaacgtttccgttaccgttaccggtacgggggtaacccgaacggggtacccgtccccggtttacggtacccctacccggtttcccttaccccg

SEQ ID NO: 410655 - DNA, 674 bp, Homo sapiens
  misc_feature: GZ8MTXP02GB44E.44.45.E01.1.454.CMB.2.raw
  modified_base (287)..(287): a, c, t, g, unknown or other
  modified_base (307)..(307): a, c, t, g, unknown or other
  modified_base (437)..(437): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagccgtgggaccgtcctgacgactctctgtgttgcgtccggactctagtttcagtgacttcngccatgcacgtggggtcccncgaggcctccgaggcgaaggggctgggaggtggggtggcaggtcattcgtggtctaggagtaggggaaaataaaagacttacgtaagtaggggtaaaacctccgggtagaaacggggtcctagtttcccncgttcctaccgaagacggtaacctaattcccgaaagaaccctacggttactaactactaaacaaagttacgaaactaatttaggaacgacgtaccggaggacctacgggacttcttacgttaactttacgttacgtaaccggtacgtaccccgttagttcccgttaccgtaaccggtcgggggtcccgaagggggttaccgtcccccgtagggttacccaccggttccctttacccg

SEQ ID NO: 410656 - DNA, 639 bp, Homo sapiens
  misc_feature: GZ8MTXP02HFE2C.44.45.E01.1.454.CMB.2.raw
  modified_base (302)..(302): a, c, t, g, unknown or other
  modified_base (378)..(378): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagtctgggttttcctcgttgctcttttaagaggtgtccagtgtcaggttcagctggtggagtcgtgggggagcgtggtccaggcctgggactcctgagactctctgtgttgcgtccgatcagttcagtgactctgccatcgcacgtggggtccccncgagcctacgaggacgaggggctgggaggtgggtcgctagtcagttcgtcggtctaggaagtaagggaaagtaaanaattacgtaagtaacggtaaaccgttcggaaggaacgggtccttacgttccgtccgtcctacgagacgtaactaactaccgaaacgaaccgtacgtagtactactaaactaaatacgtaaactagttacgaacgacgacggacggtacgtcgtacttactacttaattacgtacgtaccgtaccgtacctacgttccgttaccgtacggtacgggaaccggtacgggacccgtccgtacggtaccctacccgtccgtaccg

SEQ ID NO: 410657 - DNA, 445 bp, Homo sapiens
  misc_feature: GZ8MTXP02FW02V.44.45.E01.1.454.CMB.2.raw
  modified_base (306)..(306): a, c, t, g, unknown or other
  modified_base (438)..(445): a, c, t, g, unknown or other
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctacgtggggccagggacgccctggtcaccgtctcctcagcctccaccaagggcccagtccggtccttcccccgtggccnccctgcctccaggacgccaccgtccgagacgcacgacggccggcccctggggcctcggccctgggtaccaacggtacccttaccgttcctatacttactgtctggacgcgggctcggcgaaggcgacatagnnnnnnnn

SEQ ID NO: 410658 - DNA, 674 bp, Homo sapiens
  misc_feature: GZ8MTXP02IDHLH.44.45.E01.1.454.CMB.2.raw
  modified_base (159)..(159): a, c, t, g, unknown or other
  modified_base (300)..(300): a, c, t, g, unknown or other
  modified_base (346)..(346): a, c, t, g, unknown or other
tcagacagtatatacacgaccggtgctcgatttagtgagtcagtaagggaagggggctgggagaggagcccagcactagaagtcggcggtgtttccattcggtgatcagcactgaacacagaggactcaccatggatttgggctgagctgggttttccncgttgctcttttaagaggtgtccagtgtcaggttcagctggtggagtcgtgggggagcgtggtccagcctgggactccctgagactctcctgtgttcgcgtccggatcagtttcagtgactctgccatcgcacgtgggccncaggctccgaggcaaggggctggagtgggtgcagtcatcgtggtcngataggaaataaacgatactataggaaaaccttcggtagaaacggggccctaattaccgtcccgttactcccgaagacgaactaaacttacccgaaacgaaaccgtacccgtagttaacttaaccgttaaacctaaaattacgaaacctaaagttttacggaaagacggacccggaagggtaaccgtcgggtccttacgtaccttaaactttaacgttacggttacggaacggtaccccgtacttaccgttaccgtaaccggtcgggggaacccgtaacgggggaaccgtaccccggtcgggtaccctaacccggttcccttaccccg

SEQ ID NO: 410659 - DNA, 593 bp, Homo sapiens
  misc_feature: GZ8MTXP02IL8Z3.44.45.E01.1.454.CMB.2.raw
  modified_base (308)..(308): a, c, t, g, unknown or other
  modified_base (382)..(382): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggttgtccagtgtcaggttcagctggtggagtcgtgggggagcgtggtccagccgtgggaccgtccctgagactctcctgtgttgcgtccgactcagtttcagtgactctgccatcgctacgtcgggtcccnccaggtcctccgaggccgaaggggctggaggtgggtgcagtcagtctggtctgataggaaataaagatacgtanaggaaactccgtagaacgggcctaattcctcgtctccagagactaattaccaaagaacacgtagtactactaacaaatagtaaactaatttagaagacgaccgaggactacggcttctacttatttacgttacgtacgacgtaccctagttccgttacgtacgtcgggtaacgaacgggtacgtcccgtaggtccctaccgtccttacccg

SEQ ID NO: 410660 - DNA, 630 bp, Homo sapiens
  misc_feature: GZ8MTXP02JL49V.44.45.E01.1.454.CMB.2.raw
  modified_base (298)..(298): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggactcctgagactctcctgtgttgcgtcggactcagttcagtgactctgccatgcacgtgggtccncaggcctccgaggcgaaggggctgggagtggggtggctaggtcagtcgtggtctggataggaaagtaaagaatcgtatacggggaaacctccggtagaacggggtcctaagttcctccgtcctaccgaaggtacgaactaaacttaccaaagtaaccgtaaccgtagttaactacctaacaaagtacgaaaacctaagtttaggaagtacggaccgacggtacgtcggcttacgtacttaattacgttacgtacggacgccctaattccggttaccgtacgtcgggggaaccgaacggggtccgtccccgtggtcccgtacccgtcctcccg

SEQ ID NO: 410661 - DNA, 603 bp, Homo sapiens
  misc_feature: GZ8MTXP02JZ9WO.44.45.E01.1.454.CMB.2.raw
  modified_base (299)..(299): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggactccctgagactctcctgtgttgcgtccgactcagtttcagtgactctgccatgcactgggtccnccaggcctccgaggcgaaggggctggaggtgggtggcagtcagttctggtctgatagggaaataaagatctagtagggaaactccgtagaacggggtcctattcctccgtctaccgaagtagaacctataccaaagaacctaccgtagtactactaacaaatacgtaaactaagttgaagtacgaccgaaggtactcggtctacgtacttatttacgtacgtaaccgacgtaccctagttccgttaccgtaccgttggggaacccgtacggggaccgcccttacgggcctaccggtcctacccg

SEQ ID NO: 410662 - DNA, 666 bp, Homo sapiens
  misc_feature: GZ8MTXP02H19U9.44.45.E01.1.454.CMB.2.raw
  modified_base (298)..(298): a, c, t, g, unknown or other
  modified_base (335)..(335): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtggggagcgtggtccagcctgggactccctgagactctctgtgttgcgtccggatcagtttcagtgactctgccatgcacgtcggtccnccaggcctccgaggcgaaggggctggaggtgggtggnagtcatcgtggtctgagtaggtaaagtaaagaattactaagtacgaaaccttcggagaacgggccttagtcctccgtctcgagacgaactaaacttaccgaaacgtaaaccgtaccgtagtaactaccgtaaacaaaatacgtaaaactaaagtttaggaacgtaacgaccggacggtaacgtccggtaccttacttaccgttaagtttacgttaccggttacgtaccgtaccctaacgtttacccgttaccgttaaccgggttccgggggaacccgtaacggggtaacccgtccccggttacggtccccgtaacccgtttccgtaccccg

SEQ ID NO: 410663 - DNA, 651 bp, Homo sapiens
  misc_feature: GZ8MTXP02JDHUP.44.45.E01.1.454.CMB.2.raw
  modified_base (161)..(161): a, c, t, g, unknown or other
  modified_base (304)..(304): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcgtgggttttccncgttgctcttttaagaggtgtccagtgtcaggttcagctggtggagtcgtgggggagcgtggtccagcctgggacgtcctgagctctctgtgttgcgtccggactcagttcagtgactctcgccatcgcctacgtcgggtccnccgacgggcctcccgagggacgaacgggggcgtaggggagggttggggtggacctaggtcagttcgtgggtctaggagtaaggaaaagttaaagaattacgtagtacggaaaactccggtaggaaacggtcctattccgtccgtacctaccgagaacgtaactaacttaaccaaacgtaaacctaccgtagttaactaactaaactaaaactacgtaaactaagttagaagacgacgaagaccgtacggcttactactatttacgtacgtacgacgtaccctacgttccgttactaacggtcgggaaccgacgggtaccgtccggtcgtaccgtaccgtccttcccg

SEQ ID NO: 410664 - DNA, 679 bp, Homo sapiens
  misc_feature: GZ8MTXP02JELL7.44.45.E01.1.454.CMB.2.raw
  modified_base (302)..(302): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgaagctggtggagtcgtgggggaggcgtggtccagcctgggaggtccctgagactctcctgtgtagcgtctggatcaccttcaacagacatggcatgcacgtgggtccnccgaggcctccgaggcgaaggggctgggaggtggggtggctacgttaatagtggtatgaagtaggaaagttaaattaaattagtttaataggttaagtacgtttccgggtaggtaaacggggtcccgtaagttccaaccctaatcccttacccgaagtacaaccgtaaactttaacgaaagaaaccaactaacctaaattactacgttaaaggaaattaggaaaacttacggaccgtaggaacggacggacccggaaagggacgtaacccggggtacttacggttaccttaaccgttaacgttcgggttacggaaccggaacggtaggtaaggttcgggggaccgttacgggttagggaactaaccggtagtaaacg

SEQ ID NO: 410665 - DNA, 673 bp, Homo sapiens
  misc_feature: GZ8MTXP02F4CJA.44.45.E01.1.454.CMB.2.raw
  modified_base (286)..(286): a, c, t, g, unknown or other
  modified_base (315)..(315): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagtctgggttttcctcgttgcttcttttaagaggtgtccagtgtcaggttcagctggtggagtcgtgggggaggcgtggtccaggccgtgggaccgtccctgacgctctcctgtgttcgccgtccgactcagtttcagtnactctgccatcgctacgtcggggtccccnccgaggcctaccgagggacgaacgggggctaggggagggtggggtggcgaagtcattccgtgggtactgtaagtagggaaaagtaaaagtaattactagtaacggaaaaccgttccgtagggaaacgggcctattaccgtccgtctacgagagtaactaaactaccaaagaacctacgttacgtactaactaaacgaaatacgtaaactaagtttagaaggtacgaccggacggaccgtcggtactacgttccttaagtttacgtagtaaccgacgtacccctagttaccgtttaccgtacggtaccggggaaccgtaacgggccgtacccgttcggaccgtacccgtaccttccccg

SEQ ID NO: 410666 - DNA, 657 bp, Homo sapiens
  misc_feature: GZ8MTXP02H5EM6.44.45.E01.1.454.CMB.2.raw
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggacgtccctgagactctcctgtgttgcgtccgactcagtttcagtgactctgccatgcacgtcgggtccgccacggcctccgaggcgaaacgggggcgtgggagggtggggtcggcgtagtcagttcgtcggtcgtagtagtagggtaaaagtaaaacgtaacttacgtagtaaacgggtaaacctccggtaaggggaacgggtaccgtacttacccgtcgtacctaccgaagtaacgaaactaactaacccgtaaaagaacccgtaaccgttagtaactactaaactaaaactaacgtaaaacttaagttacgaagtacgaccggaggtaccgtacgtctactacttattagtagtacgacgacctactcgttaccgtacggtcgggaaccggacggacgtccgtacgtcctaccgtctacccg

SEQ ID NO: 410667 - DNA, 582 bp, Homo sapiens
  misc_feature: GZ8MTXP02FP1Y0.44.45.E01.1.454.CMB.2.raw
tcagacagtatatacacgaccggtgctcgatttagtgagtcagtaagggaagggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtgagtcgtgggggaggcgtggtccagccctgggacctccctgagactctcctgtgttgcgtccggactcagtttcagtgactctgccatgcacgtgggtcccgccaggcctccgaggccaaggggctgggagtggggtggcagtcatctggtctgatggaaataaagaatacagaggaaacctcgtagaaacggggccgaatttcctccgtctccaagagacaaatcaaagaacacgtagtactactaacaaatagaaactaagtttagagacgaccggaaggacgtcggcttcttcttaatttacttacgtaacgacgaccctacttccgttctaacgttcggggcccgaggggacgcccgtcggtcacccggtctcccg

SEQ ID NO: 410668 - DNA, 634 bp, Homo sapiens
  misc_feature: GZ8MTXP02F36H4.44.45.E01.1.454.CMB.2.raw
  modified_base (276)..(276): a, c, t, g, unknown or other
  modified_base (281)..(281): a, c, t, g, unknown or other
  modified_base (303)..(303): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagccgtgggacctcctgagactctcctgtgtgcgtccgactcagttcagtnactcngccatcgccacgtcgggtcccncgaggcctccgaggcgaaggggctgggacggtggggtgctagtcatcgtggtctggagtacggaaagtaaagaattacgtagtacggaaaaccttccggaggaacgggtcctattccgtccgtacctacgaagacgaactaacttaccaaacgaaccgtaccgtaacgtactaactaaacaaacgtagaaacttagttacggaagacgaccggaggaccgtcgtactactacttatttacgtacgtaacgaccgtaccctacgttaccgttaccgtacggtacggggccgtacgggaccgtacccgtacggtccctacccgttcctacccg

SEQ ID NO: 410669 - DNA, 646 bp, Homo sapiens
  misc_feature: GZ8MTXP02G22CM.44.45.E01.1.454.CMB.2.raw
  modified_base (304)..(304): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggactccctgagactctcctgtgttgcgtccggactcagtttcagtcgactctgccatcgcacgtcgggtccnccgacggcctccgaggcgaaggggctgggaggtgggtagctagtcatcgtggtctggataggggaaataaagaatacgtagtaggaaactccgaggaacggcctaattcctaccgtctaccgagaacgactaacgtacccaaagaaccctaccgtagtaactacctaaactaaaatacgtaaactaagtttacggaagaacgacggaacggaccgtacggtcttacctagtaactttacgtacgttaaaccggacctaaccctagttacccgttaccgtacggttaccggggaacgccggggaaccgtaccccgtcggtacccgtaccgttccgtacccccg

SEQ ID NO: 410670 - DNA, 586 bp, Homo sapiens
  misc_feature: GZ8MTXP02JM4ER.44.45.E01.1.454.CMB.2.raw
  modified_base (160)..(160): a, c, t, g, unknown or other
  modified_base (297)..(297): a, c, t, g, unknown or other
  modified_base (334)..(334): a, c, t, g, unknown or other
  modified_base (352)..(352): a, c, t, g, unknown or other
  modified_base (367)..(367): a, c, t, g, unknown or other
  modified_base (501)..(501): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttccncgttgctcttttaagaggtgtccagtgtcaggttcagctggtggagtctgggggagcgtggtccagcctgggactcctgagactctcctgtgttgcgtccggatcagttcagtgactctgccatgcacgtgggtccncagggcctccgaggcaaggggcctgggacggtggggngacagtcattcgtggtcngagtaggaaataaanactatagtacggaaactcgagaacgggctattccctcgtactacgagacacgtaactaccgaacgaacctacgtagtactactaactaaagtacgaaactaagttagaagacgacggacgtacgcggtctactntacttacgttacgtacgacgtacctacgttaccgtacgtacggtcgggccgtaagggcctaccggtcgtaccgtaccgtctcccg

SEQ ID NO: 410671 - DNA, 673 bp, Homo sapiens
  misc_feature: GZ8MTXP02IK9W9.44.45.E01.1.454.CMB.2.raw
  modified_base (305)..(305): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggtttttcctcgttgctcttttaagaggttgtccagtgtcaggttcagctggtggagtcgtgggggagcgtggtccagccgtgggaccgtcctgagactctcctgtgtgcgtccgatcagtttcagtgactctgccatgcacgtcgggtcccnccagggcctccgagggccgaaggggctgggaggtggggtgcagtcattccgtggtctgagtaggaaagtaaagacttacgtatacgggaaaaccttccgaggaaacggggcccttaagttccgtccgtacctacgaacgtacgtaacctaaacttacccgaaaacgtaacccgtaacccggttagtaacttaaaccttaaactaaaagtaacggtaaaccttaaagttttacggaaaggtaaccgaccggtaacgggtacgtaccggtcttacgtactttaatttacgttacgtacgacgtaccctacgttcgttaccgtacggtcggggaaccgacgggtcgcccgttggtcctaccgtcctacccg

SEQ ID NO: 410672 - DNA, 760 bp, Homo sapiens
  misc_feature: GZ8MTXP02HBB44.44.45.E01.1.454.CMB.2.raw
  modified_base (241)..(241): a, c, t, g, unknown or other
  modified_base (302)..(302): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttggctgagcttgggttttcctcgttgcttcttttaagaggtgtccagtgtcaggttcagctggtggagtcgtgggggagcgtggtccagcctggggactccngagctctctgtgttgcgtccgatcagtttcagtgactctgccatcgcacgtggggtccccncgagggccctcgagggtccgaaggggtctgggaggtcggggtgcctaggttcagtttcgtagggttctaggtaagtaaggggtaaaagtaaaagtaattaccgttaaaggtaaggggtaaaaaccccttccgggtaagggggaaaacccggggtcccttaaacgtttcccgtacccgttacgtacccgtaacggaacggtaaacctaacgttaacccgaaaacggtaaaccgtaaccgttacgtaacttaacgtaaacctaaaagtaacgtaaaacgtaagttttaggaaacgtaacgtacccgggaacggtaccgtacccggtacgttaccgtttacttaaagttttacgttacggtaacggtaccgtaccgtaacgtttacccgttaccgtaccggttacggggaacccgtaacggggacccgtcccgtacgggtccctacccgtttacgtccccg

SEQ ID NO: 410673 - DNA, 701 bp, Homo sapiens
  misc_feature: GZ8MTXP02HQ7LC.44.45.E01.1.454.CMB.2.raw
  modified_base (158)..(158): a, c, t, g, unknown or other
  modified_base (174)..(174): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcacatggagtttggctgagctgggttttccncgttgctcttttaagnggtgtccagtgtcaggttcagctggtggagtcgtgggggagcgtggtccagcctgggactcctgagactctcctgtgttgcgtccggatcagtttcagtgactctgccatgcacgtcggggtccaccagggcctccgaggcaaggggctggagtgggtgcagtcagtcgtggtactgataggaaataaacgatacgtagtaggaaaacctccgtaggaacgggcctaatccgtccgtctaccgagacgtaactaacttacccgaaaggaacctaaccggtgtaaacttaccctaaactaaaattaccggtaaaacttaaagttttacgggaagtaacggtacccggtaaggggaaaccttcggggtaccttccgttacgtttaaacgtttaattacggtttaaaccggaaacgtcccccttaaagtttaccggggtttcccttaacgggttcgggggtaaccccgttaaagggggacccttaccccggttacggggtttaccccccgtacccggtttcccgtacccg

SEQ ID NO: 410674 - DNA, 673 bp, Homo sapiens
  misc_feature: GZ8MTXP02JWZLA.44.45.E01.1.454.CMB.2.raw
  modified_base (616)..(616): a, c, t, g, unknown or other
  modified_base (655)..(655): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagccgtgggaccgtccgtgacgtactctcctgtgtgcgtccgactctagttcagtgactctcgcctatcgcctacggtcgggtccccgcgacggtcctcccggaagggaccggtaaaggggggtccgtaggggtacggttcggggggtgaccgtaggtccagttccgtcgggtactggaagttaacgggaaaagtaaaaggaattacgtaagtaacgggtaaaaccttccgggaggaacggggtccctattcccgtcccgtccgtacgaaggacgtaacctaacttaccgaaacggtaaccctacgtagttactactaaacctaaaatacgaaactaagttaggagtacgaccggtagtacgtcgcctactcttagttacttacgacgacnccttactccgtacgtcgtcgggaacgtacggctcccggngtaccctccgtctacccg

SEQ ID NO: 410675 - DNA, 562 bp, Homo sapiens
  misc_feature: GZ8MTXP02F6WKW.44.45.E01.1.454.CMB.2.raw
  modified_base (278)..(278): a, c, t, g, unknown or other
  modified_base (301)..(301): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggaggcgtggtccagcctgggacgtccctgagactctcctgtgttgcgtccgactcagttcagtnactctgccatgcactgggtcccnccaggctccgaggcaggggctggaggtgggtgcagtcatctggtctgagtaggaaataaagatactataggaaactcgtggaaacgggcctaattctccgtactccgagagaacaataccaaagaacacgtagtactactaacaaatagtaaactaatttagaagagccgaggactcggctactcttattattagtacgacgcctacttcgttacctacgtacggggctacggggacgtcccgtcggtcctaccgtctccc

SEQ ID NO: 410676 - DNA, 571 bp, Homo sapiens
  misc_feature: GZ8MTXP02IHO7A.44.45.E01.1.454.CMB.2.raw
  modified_base (274)..(274): a, c, t, g, unknown or other
  modified_base (301)..(301): a, c, t, g, unknown or other
  modified_base (411)..(411): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggacgtcctgagactctcctgtgtgcgtccgatcagttcagtnactctgccatcgctacgtggggtcccnccaggcctccgaggcgaaggggctgggaggtgggtgcagtcatcgtggtctgataggaagtaaagatatataggaaactccgtagaagggtccattccgtcgtctcaganacaacttaccaaagtaactacgtagtactactaacaaatagaactaagttgaagagcgaggctacgtctctacgttattacgttcgtacgacgtacctagtccgttacgtacggtcggggaaccgacgggtacgcccgttggtacctaccgttcctcccg

SEQ ID NO: 410677 - DNA, 688 bp, Homo sapiens
  misc_feature: GZ8MTXP02GAKX2.44.45.E01.1.454.CMB.2.raw
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagtcttgggttttcctcgttgcttcttttaagaggtgtccagtgtcaggttcagctggtggagtcgtgggggagcgtggtccagccgtgggacctcctgagactctcctgtgttgccgtccgactctagttcagtgactctgccatcgcctacgtcgggtccccgccgaggccctaccggaggtcggaaggggtctggggaggtgggtcgctagtcagttcgtggtctagagtaggaaaagtaaataatacgtaagtacggtaaaactccggtaaggaacggtcctattccgtcccgtacgtaccaaggaactaaccgtaaacttaaccgaaacgtaaccgtaccgttataactacttaaaactaaaataacgtaaaactagtttaagaacgtacggacccggtaagggtaccgtccggtacctttacgtaactttaaagtttaacgtttacggtaaacccgtacgtaccccttacgttaccgttaccgtaacggtcgggaaccgtaacgggcgtacccgtcggtacctcccgtcctacccg

SEQ ID NO: 410678 - DNA, 643 bp, Homo sapiens
  misc_feature: GZ8MTXP02FPRGQ.44.45.E01.1.454.CMB.2.raw
  modified_base (266)..(266): a, c, t, g, unknown or other
tcagacagtatatacacgaccggtgctcgatttagtgagtcagtaagggaaaggggctgggagaggaacccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggaggcgtggtccagccgtgggacgtccctgacgctctcctgtgtgcgtccgntcagttcagtgactctgccatgccacgtcgggtcccgccaggcctccgaggcgaaggggctggggacggtggggtggcgtagtcagtcgtggtcctagagtaggaaaataaagtaacttaactagtacggaaactcggtaggaacgggtccgtattccgtccgtctaccgagaacgtaactaacgttaccaaacgtaaccaccgtagtactacgtaaacaaagtagaaactagttagaagacgaccgaggtacctcgtcttacgtacttattacgtacggtaccgacgtacccgttattaccggttccgtacgggtcggggaccgaacggggtaccgtccccggttacggtacccgtacccggttccgtccctaccg

SEQ ID NO: 410679 - DNA, 669 bp, Homo sapiens
  misc_feature: GZ8MTXP02G32W0.44.45.E01.1.454.CMB.2.raw
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagctggtggagtcgtgggggagcgtggtccagccgtgggacctcctgagactctctgtgttgcgtccgactctagttcagtgactctgcccatcgctacgtcgggtccccgccgacgggtcctaccgagggccgaaggggctggggaggtggggtggcctagtcagttcgtggtactgtagtaagggaaagtaaaacgaattacgtaagtaggaaacctccggtaggaacgggcctagttccgtcccgtaaaaccgtccaagacgtaactaacttaccaaacgtaacctaccgtatactactaaacctaaagtacgtaaactaagtttagaacggacgaccggaacggtaccgtacggtaccttacgttacgttaatttacgttacgtaaccgtacgtaccctagttccgttaccgtacggttcggggaaccgtacgggtaccgtcccgtacggtcccgtaccgtcctcccg

SEQ ID NO: 410680 - DNA, 709 bp, Homo sapiens
  misc_feature: GZ8MTXP02I6L2Q.44.45.E01.1.454.CMB.2.raw
  modified_base (176)..(176): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagnggtgtccagtgtcaggttcagctggtggagtcgtgggggagcgtggtccagcctgggaccgtcctgagactctcctgtgttgcgtccgactcagtttcagtgactctgccatcgcacgtcggggtcccgcccgagggtccctccgaagggccgaaagggggctaggggaggtggggtggcaggtcattccgtggtctgagtagggaaataaagaatacgtaagtacggaaacctccggtagaaacggggtcctattccctccgtcaccgaagacgaactaagttacccaaagtaacctaccgtagtaacttactaaactaaacgtacgtaaaactaagtttaggaaacggaaccggacccggtacgggtaacccgtaccgggtaccttacgtacctttaatttaacggttacggtaaaccgtaccggtaaccccttacgttacccggtttaccgtaccgggttacgggggtaaccccggtaagggggcccggttacccgtacccgggttccgtaacccggtttcctacccccg

SEQ ID NO: 410681 - DNA, 720 bp, Homo sapiens
  misc_feature: GZ8MTXP02JQDOD.44.45.E01.1.454.CMB.2.raw
  modified_base (299)..(299): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagccgtgggactcctgagctctcctgtgttgcgtccggatcagtttcagtgactctgccatgcacgtgggtccnccaggcctccgaggcgaaggggctgggaggtggggtggcagtcatcgtgggtctaggagtaggggaaaagttaaagaatacgtaagtacgggtaaaccttccgggtaagggtaacggggcccgtaacgtttcccgtacccggttaccgttacccgaacggtaacggaaacctaaacgttacccgaaaacgtaaacccgtaacccggttagtaaacgttaacctaaaccgtaaaaagttaacggtaaaaccttaaagttttagggaaacgtaacggtacccggtaaacgggtaccgtaccggtaccttacgttacttaaagtttacgttacggtaacgacgtcccgttaacgttccgttacgtaacggtcggggtaaccgacggggtacgtcccgttaggtacccgtaccggttacctcccg

SEQ ID NO: 410682 - DNA, 627 bp, Homo sapiens
  misc_feature: GZ8MTXP02FMYNC.44.45.E01.1.454.CMB.2.raw
  modified_base (305)..(305): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgctcttttaagaggtgtccagtgtcaggttcagctggtggagtcgtgggggagcgtggtccagccgtgggacgtcctgagactctcctgtgttgcgtccgactcagttcagtgactctgccatcgcacgtcggggtcccnccagggcctccgagggcgaaggggctgggaggtggggtggcaggtcagttcgtggtctgagtaggaaagtaaagaatactagtacgggtaaaacctccggtagaaacggggtccctatttaccgtccgttacctacccgaagacgtaactaacttacccgaaacgaacctacgtagtactactaacaaatagaaactaagtttagaagtacgaccgaggtacgtcggctactacgtattacgtacgtacgacgtacctacgttccgttacgtacggtcgggaaccggacgggtaccgcccgtcggtacctacccgtctcccg

SEQ ID NO: 410683 - DNA, 651 bp, Homo sapiens
  misc_feature: GZ8MTXP02IYT7H.44.45.E01.1.454.CMB.2.raw
  modified_base (277)..(277): a, c, t, g, unknown or other
  modified_base (303)..(303): a, c, t, g, unknown or other
  modified_base (355)..(355): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagctggtggagtcgtgggggagcgtggtccagccgtgggacctcctgagactctctgtgtgcgtccgactcagttcagtnactctgccatgctacgtcgggtcccnccgaggtcctccgaggcgaaggggctgggagtgggtgcagtcagtcgtggtntgagtaggaaaataaagaacttacgtagtacggaaaactccggaggaaacgggcctattcgtcccgtctccgaagagactaacttaccaaagaaccacgtagtaactaacctaaataaactacgtaaacttaatttaggaacgtaacggaccggaacggtaccgtaccggtacttacttacttaacgtttaacgttacgtaaaccgtaccgtaccctaacgtttccgtttacggtacggtcggggtaaccggtacgggtaccgtccccgtgggtaccctaacccgttccctccccg

SEQ ID NO: 410684 - DNA, 641 bp, Homo sapiens
  misc_feature: GZ8MTXP02GI1BP.44.45.E01.1.454.CMB.2.raw
  modified_base (283)..(283): a, c, t, g, unknown or other
  modified_base (303)..(303): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcagggttcagctgggtggagtcgtgggggagcgtggtccagcctgggactcctgagactctcctgtgttgcgtccggactcagttcagtcactcngccatgccacgtcgggtccnccaggcctccgaggcgaaggggctgggagtgggtggctagtcattcgtgggtactgagtaggaaagtaaaacgaattacgtagtacggaaaactccgtaggaaaacgggcctattacctcccgtactacccgaaggacaaactaaacttaccgaaaacgaaaccgtaacccgtagtaacttactaaacaaaataacgtaaaactaagtttaggaagaacggaccgaacggacgtcggacctacttactaagtttatacggttaacgacgtaccctagttcgttacgtacgttacggggccgaaacgggccgtacccgtggtaccacccggtctacccg

SEQ ID NO: 410685 - DNA, 714 bp, Homo sapiens
  misc_feature: GZ8MTXP02GKGO5.44.45.E01.1.454.CMB.2.raw
  modified_base (305)..(305): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgcttcttttaagaggtgtccagtgtcaggttcagctggtggagtcgtgggggagcgtggtccagcctgggacgtcctgagactctctgtgttgcgtccgactctagtttcagtgactctgccatcgctacgtcgggtcccnccagggcctccgaggccgaaggggctgggaggtgggtggcagtcagttcgtggtctgagtagggaaagtaaaacgaatacgtaagtacggaaaaccgttccgggaagaaacggggccttaacgttcccgtacccgtccttaccgaacgtaacgaacctaaacgttacccgaaaacgaaacccgtaacccgttacgtaacttaaacctaaacctaaaagttaacggtaaaacttaaagtttaggaaagtaacgaacccggtaacgggtaaccgtccggtaccttactactttaagtttaacgttacgtaacgtaaccgtcccctaaagtttcccgttacgttaccggtacggggcccgtaacggggtaccggtccccgttacgggtacccctacccggttccctaccccg

SEQ ID NO: 410686 - DNA, 724 bp, Homo sapiens
  misc_feature: GZ8MTXP02F6BE9.44.45.E01.1.454.CMB.2.raw
  modified_base (491)..(491): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggaggcgtggtccagcctgggacgtcctgagactctcctgtgtgcgtccgactcagtttcagtgactctgccatcgcacgtgggtccgccaggcctccgaggccgaaggggctggagtggggtggctagtcattccgtggtctgatagggaaataaaagaattacgtagtacggtaaaaccttccggagaaacgggggccctaattccgtcccgtacctccgaagacgaacctaaattacccgaaaagaacccgtaaccgtagtaacttaccctaaanaaacttacggaaacttaacgttttaggaacgaaacggacccggaaacggtaaccgttaccgggtccctacgtttaccttaaaagtttacgttttacggggtaaaacctacccggtaaccccttaacgtttacccggtttaccgtaaccggttaccggggggaaccccgtaaagggggtaaccggtcccccgttacgggggtacccctaaccccggtttccctttaacccccgg

SEQ ID NO: 410687 - DNA, 618 bp, Homo sapiens
  misc_feature: GZ8MTXP02HSY36.44.45.E01.1.454.CMB.2.raw
  modified_base (302)..(302): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttggctgagcttgggttttcctcgttgcttcttttaagaggtgtccagtgtcaggttcagctggtgagtcgtgggggagcgtggtccagccgtgggactcctgagctctctgtgttgcgtccggatctagtttcagtgactctgccagtgccagtcgggtcccncaggcctccgaggcgaggggctggagtggggtgctagtcagtcgtaggtctagattagggaaattaaaacgatacgtagtacggtaaacctccgtaagggaacgcctatcctccgtactacgaagacgaactaactaccaaacgtaacctacgtactaactactaaacgtaaatataaactaagttagaacgtacgacgacgtacgtcgacttactacttaattacgttacgtaaccgtacgacccttaattcccgttacgtaaccggtcggtaaccgaagggccgttacccgcgtacccgaccgtttcctccccg

SEQ ID NO: 410688 - DNA, 718 bp, Homo sapiens
  misc_feature: GZ8MTXP02JOBPR.44.45.E01.1.454.CMB.2.raw
  modified_base (311)..(311): a, c, t, g, unknown or other
  modified_base (357)..(357): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactacaccatggagtttgggctgagcttgggttttcctcgttgctcttttaaggaggtgtccagtgtcaggttcagctggtggagtcgtgggggagcggtggtccagccgtgggacctcctgagactctctgtgttgcgtccgatcagtttcagtgactctgacccatcgcctacgtcggggtcccnccgaggcctaccggaggtaccgaaggggctagggagggttcggggnggtacgagttcgagtttcggtcgggtactagggtaagtaaggggtaaacgtaaaagtacttacgttaggaacggggtaaaaccttccggtaagggaaacgggtcccgttaattcccgtaccgtactacccgaaggaactaaccgtaaacgttccgaaaacggtaaaccgtacgttacgtaaattaaccccgaaataaaaggtacgtaaaactaagtttagggaacgtaacggtaccggaacggtaaccggtcggtaccttacgttactaacgtttacgttacgacgtacgtacccgttacgtaccgtttccgaacggtcggggtaaccgagggtacctcggtacggtcctacgtcctaccg

SEQ ID NO: 410689 - DNA, 639 bp, Homo sapiens
  misc_feature: GZ8MTXP02F8TD2.44.45.E01.1.454.CMB.2.raw
  modified_base (302)..(302): a, c, t, g, unknown or other
  modified_base (485)..(485): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagctggtggagtcgtgggggagcgtggtccagccgtgggacctccctgagctctctgtgtgcgtcgactcagttcagtgactctgccatcgcacgtcgggtcccnccgaggcctccgaggcgaagggggctgggagtgggtggctagtctagtcgtggtctagagtaggaaacgtaaagattacgtagtacggaaaacttccggagaacgggtcctacgttccgtcccgtctacccgaagacgtaactaacgttaccgaaagaacctaccgttagtaactacctaaanaaatagtaaactaagtttacgaagtacgccgaaggtctacggactcgtacttaacgtttagttacgacgtactaccctacgttccgttaccgtacggtcggggaacccgtacggggtacctccccggttaggtaccccgtccgttcctaccccg

SEQ ID NO: 410690 - DNA, 701 bp, Homo sapiens
  misc_feature: GZ8MTXP02FJL38.44.45.E01.1.454.CMB.2.raw
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagctggtggagtcgtgggggagcgtggtccagccgtgggaccgtcccctgacgctctcctgtgttgccgtccggactcagttcagtgactctcgcccatcgcctacgtcggggtccccgccgagggccctaccggagggcgaaagggggtctggggaggtggggtggctagtcagttcgtagggtctaggagttacggaaaagtaaaagtaattacgaagtaacggtaaaaccttccgggtaaggaaacgggggccctattcccgtacccgtacctacccgaaggacgaaactaaaccttaccaaaacgtaaaccgtaccgttagtaacttaacctaaactaaaacttagtaaaccttaagtttacgaagacgaccggaacggtaccgtacggtcctacttacttaagtttacgttgtaccgaccgtaccctagttccgttacgtaccggtacgggggaaccgacgggaccggtcccgtacggtccgtacccgtccgtaccccg

SEQ ID NO: 410691 - DNA, 672 bp, Homo sapiens
  misc_feature: GZ8MTXP02JCK44.44.45.E01.1.454.CMB.2.raw
  modified_base (160)..(160): a, c, t, g, unknown or other
  modified_base (176)..(176): a, c, t, g, unknown or other
  modified_base (247)..(247): a, c, t, g, unknown or other
  modified_base (275)..(275): a, c, t, g, unknown or other
  modified_base (279)..(279): a, c, t, g, unknown or other
  modified_base (302)..(302): a, c, t, g, unknown or other
  modified_base (368)..(368): a, c, t, g, unknown or other
  modified_base (624)..(624): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttccncgttgctcttttaagnggtgtccagtgtcaggttcagctggtggagtctgggggagcgtggtccagcctgggactccctgagactcncctgtgttgcgtccgatcagtttcagtnactngccatcggacacgtcgggtcccncaggtcctaccgacggtaccgaaggggtctggggaacggttggggtacgccgtagtccagttccgngggtctggaatacggggaaaattaaaggacttacgttaggacggtaaaacctccggtagggaaacgggccttaattccgtaccgttcacgtacgacgtaacctaaacgttaccgaaacgtaccgtaaccgtagtacttaaacctaaactaaaagtaccgtaaaacgttacttaggaaacgacggacccgaaggtacctaacggtacttcgtaaacttagtttactacggttacacgtccctaacgtccgtttaacnccggtagggcctacggggacctccggtacgtccgaccttcgtaccccg

SEQ ID NO: 410692 - DNA, 619 bp, Homo sapiens
  misc_feature: GZ8MTXP02GECRB.44.45.E01.1.454.CMB.2.raw
  modified_base (269)..(269): a, c, t, g, unknown or other
  modified_base (272)..(272): a, c, t, g, unknown or other
  modified_base (280)..(280): a, c, t, g, unknown or other
  modified_base (284)..(284): a, c, t, g, unknown or other
  modified_base (305)..(305): a, c, t, g, unknown or other
  modified_base (333)..(333): a, c, t, g, unknown or other
  modified_base (339)..(339): a, c, t, g, unknown or other
  modified_base (389)..(389): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagctggtggagtcgtgggggagcgtggtccagccgtgggacctccctgacgctctccgtgtgtgccgtccgntcngttcagtnactntcgccatcgcacgtcgggccncgacgctccgaggcgaaggggctagggngtgggngctgtcatcgtggtcagatagggaaactaaagatacgtagaggtaaaccncggtaggaacggtcctattcctcgtcctacgagaacgaactaaactaccaaagaaccgtacgtactaactaactaaacaaatagtaaactaagttagaagacgaccggaaggaccgttacggcttacctattaactttacgtacgtaacgccgtaccgttacgttccgttaccgtacgggtacgggaaccggtacgggtaccgtcccgtcggtcccgtaccgtccctccc

SEQ ID NO: 410693 - DNA, 702 bp, Homo sapiens
  misc_feature: GZ8MTXP02HRB1H.44.45.E01.1.454.CMB.2.raw
  modified_base (279)..(279): a, c, t, g, unknown or other
  modified_base (314)..(314): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgtttgcttcttttaagaggtgtccagtgtcaggttcagctggtggagtcgtgggggagcgtggtccagcctgggacctcctgagtctctctgtgtgcgtccgatcgtagtttcagtnacctcgtcgccattcgaccgtcgttcggggccccnccgagggtccctccggagggaccgaaggggggtctaggggacggttgggggtcggcaacgttcagttccggtggggtctaggagttaaaggggtaaaataaaacggtattacgtaggtaaccggtaaactccgggtagggaacgggtcctacgttcccgtaccgtctacaacgactaactaacttaccgaaagaacccgtacgtagtaactacgtaaactaaagtaactaaacgtagttacggagtacgaccgtaggactcggtaccttcgtacttagttacgttacgtacgtacccgtacctacgtttacccgttaaccggttccggtaccggggtaaccgtacgggtacccggtccgtcggtacccgtacccgttcgttacccccg

SEQ ID NO: 410694 - DNA, 700 bp, Homo sapiens
  misc_feature: GZ8MTXP02F3N8N.44.45.E01.1.454.CMB.2.raw
  modified_base (299)..(299): a, c, t, g, unknown or other
  modified_base (332)..(332): a, c, t, g, unknown or other
  modified_base (363)..(363): a, c, t, g, unknown or other
tcagacagtatatacacgaccggtgctcgatttagtgagtcagtaagggaaagggctgggagaggagcccagcactagaagtcggcggtgtttccattcggtgatcagcactgaacacagaggactcaccatggagtttgggctgagctgggttttcctcgttgctcttttaagaggtgtccagtgtcaggttcatctggtgagtcgtgggggagcgtggtccaggcctgggactccctgacgactctctgtgttgcgtcggactcagtttcagtgactctgccatgcacgtgggtccnccaggcctccgaggcgaaggggctggagtgggngcagtcatcgtgtctgagtagaaagtaaaanaattactaagtggtaaaacctccgtaggaaacgggtcccgtaattccgtaccgtctaccaagaacgtaactaaattacccaaaaggaaaccctaacccgggttagtaaacttaacgtaaaacccgtaaaataacggtaaaacctaaagttttagggaaacggaacgtacccgggtaaaggaccgttaccgggaccttaccgttaccgtttaatttaacgttttgaaacccgtacggtaccccctaaagtttcccgtttaaccgtacggttaccgggggaaccgtaacggggaccgtaccccggttcggttaacccgtaccccggtcctttacccccg

SEQ ID NO: 410695 - DNA, 612 bp, Homo sapiens
  misc_feature: GZ8MTXP02H0G6D.44.45.E01.1.454.CMB.2.raw
  modified_base (308)..(308): a, c, t, g, unknown or other
  modified_base (520)..(520): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggtttttcctcgttgcttcttttaagaggttgtccagttgtcaggttcagctggtggagtcgtgggggagcgtggtccaggcctgggacctccctgacgctctcctgtgttgcgtccggactcagtttcagtgactctgccatcgcacgtgggcccnccaggcctccgaggcgaaggggctagggaggtggggtgacagttcagttcgtgggttactagagtagggaaagtaaaagaacttacgtaagtaaggtaaaacctccggtaaggaacggcctattccgtccgtctaccgagacgactaacttaccaaagtaaccacgtatactactaactaaatgtaaactaagttagagacgacgaggtacncgctatctaattactacgtacgacgaccctattccgttactacggtcggggaaccgacggggacctccgtcgtacccgtaccggttctcccg

SEQ ID NO: 410696 - DNA, 514 bp, Homo sapiens
  misc_feature: GZ8MTXP02HP7QC.44.45.E01.1.454.CMB.2.raw
  modified_base (161)..(161): a, c, t, g, unknown or other
  modified_base (177)..(177): a, c, t, g, unknown or other
  modified_base (258)..(258): a, c, t, g, unknown or other
  modified_base (267)..(267): a, c, t, g, unknown or other
  modified_base (282)..(282): a, c, t, g, unknown or other
  modified_base (338)..(338): a, c, t, g, unknown or other
  modified_base (400)..(400): a, c, t, g, unknown or other
  modified_base (412)..(412): a, c, t, g, unknown or other
  modified_base (423)..(423): a, c, t, g, unknown or other
  modified_base (429)..(429): a, c, t, g, unknown or other
  modified_base (454)..(454): a, c, t, g, unknown or other
  modified_base (468)..(468): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttccncgttgctcttttaagnggtgtccagtgtcaggttcagctggtggagtcgtgggggagcgtggtccaggccgtgggacctcctgagactctcgtggtntgcgtccgntcagttcatgactcngccatcgctgtcgggtccgccaggcctaccgaggccgaagggctggagtggggtcnagttcagtctggtcagactaggaagtaagaatcgtagtacgaactcgagacggcatcgctcnatcatatcgaanacgctagctanacgaanctaatagtcgagcgacgtagctcgntactatatgtacgnacgtcctagtctcgtagaggccgaggctccgtaggcctacgtctcg

SEQ ID NO: 410697 - DNA, 669 bp, Homo sapiens
  misc_feature: GZ8MTXP02I99DY.44.45.E01.1.454.CMB.2.raw
  modified_base (300)..(300): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggacgtccctgagactctctgtgttgcgtccgatcagttcagtgactctgccatgcacgtcgggtcccnccaggcctccgaggccgaaggggctagggaggtgggtggcagtcatcgtggtctagagtaggaaagtaaagaatacgtaagtagggaaaacctcggtaggaaacggggtcctagttacccgtccgttccctacccgaaggaacgtaaacctaaacttacccaaaacgtaacctaacccgtagtaacttactaaactaaaagtacgtaaaataagtttaggaacgacggtaccggaaggaccgtacggtacttaccgtacttaagtttacttaggtaccgacggtaccctattccgtttaccgtaaccggtggggtaacccgaacgggggtacccgtcccggttacggtaccctacccggtacctccccg

SEQ ID NO: 410698 - DNA, 624 bp, Homo sapiens
  misc_feature: GZ8MTXP02FHAPO.44.45.E01.1.454.CMB.2.raw
  modified_base (303)..(303): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcccgtgggacgtccctgagactctcctgtgttgcgtccggactcagttcagtgactctgccatgctacgtggtccnccagcctccgaggccgaagggggcttagggacggtggggtggcgtagtctagtctgggtctgagtagggaaagtaaagaatacgtagtacggtaaacgtccggtaggaaacggggccctaagtttcctaccgttcctacccgagacgaactaactaccgaaagaaccacgtagtaactactaaacaaatagtaaactaagtttagaagacgtaccgaggtacgtcggtactctactattaacgttcgtacacgtcccattaccgtcgaccggtggggaacccgtacggggacgtacccgtggtacccaccggtcctacccg

SEQ ID NO: 410699 - DNA, 644 bp, Homo sapiens
  misc_feature: GZ8MTXP02JGKIO.44.45.E01.1.454.CMB.2.raw
  modified_base (158)..(158): a, c, t, g, unknown or other
  modified_base (174)..(174): a, c, t, g, unknown or other
  modified_base (178)..(178): a, c, t, g, unknown or other
  modified_base (289)..(289): a, c, t, g, unknown or other
tcagacagtatatacacgaccggtgctcgatttagtgagtcagtaagggaaagggctgggagaggagcccagcactagaagtcggcggtgtttccattcggtgatcagcactgaacacagagactcaccatggagtttggctgagcttgggttttccncgttgctcttttaagnggtntccagtgtcaggttcagctggtggagtcgtgggggagcgtggtccagccgtgggacctcctagacgactctcgtgtgttcgcgtaccggtatcgtagttcagtcgacttcncgccagtcgcctacgtcgggtcccacgaggcctaccggaggaccggaaggggtctaggggagtcggggtagcctagtcacgttcgtggggtacagtagtaaggaaataaaacgattcgagtaacggaaaccgttccggaaggacggtcctacttcgtcccgttacaccgaagacgaaccgttaactacccgaaagaccctacggtataacttaaccaaagtaaataacggtaaattaattaggaacgacgacggtacgtaacctcggtcttaccgtattacgttaagtcgaaacggtctaccctagttcgtaacgttcggcgggtaacgacggtcgcccgtagtcccgtctctcc

SEQ ID NO: 410700 - DNA, 572 bp, Homo sapiens
  misc_feature: GZ8MTXP02IX9VW.44.45.E01.1.454.CMB.2.raw
  modified_base (160)..(160): a, c, t, g, unknown or other
  modified_base (256)..(256): a, c, t, g, unknown or other
  modified_base (342)..(342): a, c, t, g, unknown or other
  modified_base (439)..(439): a, c, t, g, unknown or other
  modified_base (488)..(488): a, c, t, g, unknown or other
tcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttccncgttgctcttttaagaggtgtccagtgtcaggttcagctgggtggagtctgggggagcgtggtccagcctgggacgtcctgagactctcctgtgtncgtccggatcagtttcagtgactctgccatgcacgtgggtccgccaggctccacggcgaaggggctggagtggtgcagtcagtcgngtctgatggtaaataaagatacgtaatcggaaaacttccgaggaaacgggcgaattcgccgtactccagaagacaaattccaaagaacctaaccgtntatctaacaaatagtaactaatttgaacgagccgaaggctcggactctnttaattacgttcgtacgtacgtacctacgttccgttactacggtcgggaaccgtacgggacgtccgtggtacctaccgtcctcc

SEQ ID NO: 410701 - DNA, 546 bp, Homo sapiens
  misc_feature: GZ8MTXP01CGW34.51.61.F06.1.454.CMB.2.raw
  modified_base (252)..(252): a, c, t, g, unknown or other
  modified_base (267)..(267): a, c, t, g, unknown or other
  modified_base (275)..(275): a, c, t, g, unknown or other
  modified_base (288)..(288): a, c, t, g, unknown or other
  modified_base (352)..(352): a, c, t, g, unknown or other
  modified_base (375)..(375): a, c, t, g, unknown or other
tcagcgatcgtatacacgaccggtgctcgatttagctacgctctaagggaaaggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcagggcattagctatttcttagcctggtancaagacaaaaaccgngggaaacncccctaagctccngatctatgctgcatcccactttgacaaactggactcccatcaaggttcagcggcagtggatcgngggacagaacttcactctacaanatcagcagcctgccagcctagaagtattttggactaactttattactagtccaaactagtacctttaaatcctttagtccctgggaaccgtttcggacccgaaaggggacctaaaggggtcgaaaattcaaaacggaacgttggtggtactcggacctaaccgaagtttcg

SEQ ID NO: 410702 - DNA, 558 bp, Homo sapiens
  misc_feature: GZ8MTXP01AO4M0.51.61.F06.1.454.CMB.2.raw
  modified_base (269)..(269): a, c, t, g, unknown or other
  modified_base (277)..(277): a, c, t, g, unknown or other
  modified_base (540)..(540): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagctatttcttagcctggtatcagacaaaaaccgngggaaacncccctaagctcctgatctatgctgcatcccatttgacaaactggatcccatcaaggtcagcgcagtgatcgagggacagaattcactctcacaatcagcagcctgcagcctagaacgtattttcggacttaaactttattactagttacaaacgtagttacttaaatacctttaacgtcccgtacggtaaccgttcggaccgaaacggggttaacccgaaagggttacggaaacgttaccgaaaacggtaactggtcgcgtancctaacgttaacgttccg

SEQ ID NO: 410703 - DNA, 493 bp, Homo sapiens
  misc_feature: GZ8MTXP01CZ0C1.51.61.F06.1.454.CMB.2.raw
  modified_base (253)..(253): a, c, t, g, unknown or other
  modified_base (274)..(274): a, c, t, g, unknown or other
  modified_base (382)..(382): a, c, t, g, unknown or other
  modified_base (385)..(385): a, c, t, g, unknown or other
  modified_base (387)..(388): a, c, t, g, unknown or other
  modified_base (392)..(392): a, c, t, g, unknown or other
  modified_base (417)..(417): a, c, t, g, unknown or other
  modified_base (490)..(490): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcagggcattagctatttcttagcctggtancagacaaaaaccgagggaacncccctaagctcctgatctaatgctgcatcccgtactttgacaaactggactcccaagtcaaggttcagcggacagtgatcagggacagaattcacttcacacagtcancancnncacncatatattagtactattatatatanatatactactactactctcgtaacgtcgacgacgacgaagtaagaagacaacgaagtagtcgcgcgactaacnctc

SEQ ID NO: 410704 - DNA, 528 bp, Homo sapiens
  misc_feature: GZ8MTXP01DLOQ7.51.61.F06.1.454.CMB.2.raw
  modified_base (255)..(255): a, c, t, g, unknown or other
  modified_base (278)..(278): a, c, t, g, unknown or other
  modified_base (429)..(429): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttggccgggcagtcagggcattagctatttcttagcctggtancaagacaaaaaccgagggaaacncccctaagctcctagatctatgctgcatcctactttgacaaacgtggactcccatcgaagtcagcggacagtggatcgtagggacagaattcactctacaacaatcagcagcctgcagcctagaagttatttaggacttaaacttattacntaccaatatacttaatacttatccgtggtaactcggacgaaagggacgtaaaggtaagaaacttcgaaaacgtaagtggtcgtcacgctaaccttgtcg

SEQ ID NO: 410705 - DNA, 531 bp, Homo sapiens
  misc_feature: GZ8MTXP01EZED5.51.61.F06.1.454.CMB.2.raw
  modified_base (273)..(273): a, c, t, g, unknown or other
  modified_base (285)..(285): a, c, t, g, unknown or other
  modified_base (401)..(401): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcagggcattagctatttcttagcctggtatcagacaaaaacgaggaaacncccctaagctcngatctatgctgcatccctatttgactaaactggactccatcaaggtcagcggacagtgatcgtagggacagtaattcaactctacacaatcagcacgcctagcagcctagaaagtnttttggacttaaactttattactagtacaaactagtacttaaataccgttatccgtggtaacgttcggacgaaacgggacgaaaggtaagaaattcaaaacgtaactagtcgctaccacctaattcgtcg

SEQ ID NO: 410706 - DNA, 545 bp, Homo sapiens
  misc_feature: GZ8MTXP01CX8AW.51.61.F06.1.454.CMB.2.raw
  modified_base (265)..(265): a, c, t, g, unknown or other
  modified_base (273)..(273): a, c, t, g, unknown or other
  modified_base (354)..(354): a, c, t, g, unknown or other
  modified_base (396)..(396): a, c, t, g, unknown or other
tcagcgatcgtatacacgaccggtgctcgatttagctacgctctaagggaaaggggagtcagtcccagtcaggacacagcatggacatgagggtcccgctcagctcctggggctcctgctgctctggctcccaggtgccagatgtgacatccagttgacccagtctccatccttcctgtctgcatctgtaggagacagagtcacatcacttgccgggccagtcagggcattagctatttcttagcctggtatcagacaaaaacgngggaaacncccctaagctcctgatctatgctgcatcccaatttgacaaactggatcccatcaaggttcagcgacagtgatcgtaggganagtatcactctacacaatcagcagcctagcacgctagaattntttaggacttaattattacgtgtaaccaagtacttaactttaaactacttacgtaccgttcgggtaacgttcggaccggaaacggaaccgtaaagggtagttaaaacttcgaaaacgtaactggtcggactcgactaaccgttaattcg

SEQ ID NO: 410707 - DNA, 578 bp, Homo sapiens
  misc_feature: GZ8MTXP01C9C18.51.61.F06.1.454.CMB.2.raw
  modified_base (268)..(268): a, c, t, g, unknown or other
  modified_base (416)..(416): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcacatcacttgccggcagtcagggcattagctatttcttagcctggtatcaagacaaaaaaccgngggaaacgcccctaagctcctgatctatgctgcatccctacttgacaaactggacgtcccatctaaggttcagcggacagtggatcgtagggacagaacttcactctacaactaatcagcaagcctgaccagtacctggtaaaagttnttttaggacttaaactttattactgtaacccaatactacctttaaatccttatcccgtcggtaacgtttcgggacctaaagggggaccctaaaggggtcgaaaaacgttcaaaaacggtaaccgttggtcgggtaccctggaccctaacccgaagtttcccg

SEQ ID NO: 410708 - DNA, 586 bp, Homo sapiens
  misc_feature: GZ8MTXP01AT7RE.51.61.F06.1.454.CMB.2.raw
  modified_base (274)..(274): a, c, t, g, unknown or other
  modified_base (376)..(376): a, c, t, g, unknown or other
  modified_base (404)..(404): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttctgtctgcatctgtaggagacagagtcacatcacttgccggcagtcagggcattagctatttcttagcctggtatcaagacaaaaaccgagggaaacncccctaagcctcctgatctatgctgctactcctaactttgactaaacgtggactcccatcaaggttcagcgcagtggatcgtagggacagattcactcacanatcaagcagcctgcagcctagaaagttnttttacggacttaaactttattacctagtaaccaaactacgttaactttaaatcctttaacgtcccgtacgggtaaccgttacgggacccgaaagggttaacccgtaaagggtaaggaaaacttaacgaaaacggtaacgtggtaacgggtaacctacggttaaacctcgtttcctttaacg

SEQ ID NO: 410709 - DNA, 590 bp, Homo sapiens
  misc_feature: GZ8MTXP01AZSPJ.51.61.F06.1.454.CMB.2.raw
  modified_base (276)..(276): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggccagtcagggcattagctatttcttagcctggtatcaagacaaaaacgagggaaacncccctaagctcctgatctatgctgctactccctatttgactaaacgtggacgtcccataccgaaaggttcagtcggacagtggatcgtaggggacagaattcactctacaacaatcagcacgcctagcaacgccttagaaagttcttttggacttaaactttattactgtacaactgtacctttaatactttactcccgttcggggtaacctttaccggggaccgtaaacggggaacccgtaaaggggtaacggttaaaacttaccgaaaacggtaaccgtggtaacggctacggactaaccgttaacgttccg

SEQ ID NO: 410710 - DNA, 526 bp, Homo sapiens
  misc_feature: GZ8MTXP01BOJGM.51.61.F06.1.454.CMB.2.raw
  modified_base (272)..(272): a, c, t, g, unknown or other
  modified_base (389)..(389): a, c, t, g, unknown or other
tcagcgatcgtatacacgaccggtgctcgatttagctacgctctaagggaaaggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcatttcttagcctggtatcagcaaaaaccagggaaancccctaaagctcctgatctatgctgcatccatttgcaaactggatccatcaaggttcagcggcagtggatcgtgggacagaatcactctcacaatcagcagcctgcagcctgaagtnttttggactaactttatactgtacaactagtaccttaaatacttatccgtcggtaacgttcggaccgtaaagggaccgtaaagggtaggaaacttacaaaacgtaacgtgtcggctggacctaaccgttaagttccg

SEQ ID NO: 410711 - DNA, 568 bp, Homo sapiens
  misc_feature: GZ8MTXP01DFHA7.51.61.F06.1.454.CMB.2.raw
  modified_base (253)..(253): a, c, t, g, unknown or other
  modified_base (273)..(273): a, c, t, g, unknown or other
  modified_base (441)..(441): a, c, t, g, unknown or other
  modified_base (563)..(563): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagctatttcttagcctgtancaagacaaaacgaggaaacncccctaagctcctgatctatgctgcatcctacttgacaaacgtgactccatcaaggttcagcggacagtggatcgtagggaacagtaattcactctacaacgaaatcaagcaaggccctgccaaggcctagaaagttattttacggaaccttaaactttattaacgtntaccaaactagttaactttaaatacgttacgtcccgtacgggtaacgtttcggaccgtaaaggggaccgtaaagggtagaaaacttcgaaaacggtaactgggtcgtactgacctaaccttnttccg

SEQ ID NO: 410712 - DNA, 559 bp, Homo sapiens
  misc_feature: GZ8MTXP01DHTSU.51.61.F06.1.454.CMB.2.raw
  modified_base (251)..(251): a, c, t, g, unknown or other
  modified_base (263)..(263): a, c, t, g, unknown or other
  modified_base (270)..(270): a, c, t, g, unknown or other
  modified_base (283)..(283): a, c, t, g, unknown or other
  modified_base (433)..(433): a, c, t, g, unknown or other
  modified_base (443)..(443): a, c, t, g, unknown or other
tcagcgatcgtatacacgaccggtgctcgatttagctacgctctaagggaaaggggagtcagtcccagtcaggacacagcatggacatgagggtccccgctcagctcctggggctcctgctgctctggctcccaggtgccagatgtgacatccagttgacccagtctccatccttctgtctgcatctgtaggagacagagtcaccatcacttgccgggcagtcagggcattagctatttcttagctggtancagacaaaaacnggaaacncccctaagctccngatctatgctgctatcctactttgactaaactggactcccatccgaaagttccaagcggaacagtggatcgtgggaacagtaattcaactctacaactaagcagctagcctagccagcctagaagtattttggacttaaatttattactntacaaactanacctttaaataccttaatcccgtgggtaacgttccggaccgtaaacggggaacctaaaggggtagaaaacttcgaaaaccggaatggtaacgggctagactaacgttaacgtaacg

SEQ ID NO: 410713 - DNA, 573 bp, Homo sapiens
  misc_feature: GZ8MTXP01BBS0L.51.61.F06.1.454.CMB.2.raw
  modified_base (278)..(278): a, c, t, g, unknown or other
  modified_base (410)..(410): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttggccggcagtcagggcattagctattttcttagcctggtatcaagacaaaaaccgagggaaacncccctaagctcctgatctatgctgcatccatttgactaaacgtgacgtccagtacgaaggttcaggcggacaggtggatcgtgggacagtactcactctacacatcagctagcctgacagcctagaacgttnttttacggacttaaactttacttactagtacaaacgtatactttaaactacttaactcccgtcggtaaccgttcgggaaccgaaacgggttaccgtaaaggtaagggaaaacttcgaaaacgtaacttggtaacgggtcgtacgacctaacgttaacgttccg

SEQ ID NO: 410714 - DNA, 597 bp, Homo sapiens
  misc_feature: GZ8MTXP01DBQA8.51.61.F06.1.454.CMB.2.raw
  modified_base (258)..(258): a, c, t, g, unknown or other
  modified_base (282)..(282): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtcctccattccttcctgtctgcatctgtaggagacagatcacatcacttggccgggcagtcgagggcattagctatttcttagccttaggtancaagaacaaaaaccgagggaaacncccctaagctacctgatctatgtctgactacttccctatttcgactaaacgtcggactacccagtaccgaaggttcaggcgaacgtagtggatcgtagggaactagtaacttcactctacacaatcagacacgcctgaccacgtactagtaagttactttaggaaccttaatttactactacactaaactattacctttaaataccttacgtccggttaacggtaacggttaccgaacggtaaacgggaaccgtaaagggtacgaaaacttccgaaaacggtaacttggcgtaactcgacctaaccttgtttccg

SEQ ID NO: 410715 - DNA, 522 bp, Homo sapiens
  misc_feature: GZ8MTXP01B7Q43.51.61.F06.1.454.CMB.2.raw
  modified_base (273)..(273): a, c, t, g, unknown or other
  modified_base (438)..(438): a, c, t, g, unknown or other
  modified_base (508)..(508): a, c, t, g, unknown or other
tcagcgatcgtatacacgaccggtgctcgatttagctacgctctaagggaaaggggagtcagtcccagtcaggacacagcatggacatgagggtccccgctcaactcctggggctcctgctgctctggctcccaggtgccagatgtgacatccagttgacccagtctccatccttcctgtctgcatctgtaggagacagagtcaccatcacttgccgggcagtcagggcattagctatttcttagcctggtatcagacaaaaaccaggaaacncccctaaagctcctgatctatgctgcatccactttgactaaactggaactccccaatccaaaggttcagcggcaagtggaatcgtgggacagaacttcactctacacaatcagcagcctgcagcctagaagtatttgactaaactttattaactgtacaaacgtntactttaaatacttatcctacggacgttcggacaaggggaccaagggtagaaattacgaaagactgtggntgcacgtaattctg

SEQ ID NO: 410716 - DNA, 549 bp, Homo sapiens
  misc_feature: GZ8MTXP01ERSBX.51.61.F06.1.454.CMB.2.raw
  modified_base (253)..(253): a, c, t, g, unknown or other
  modified_base (273)..(273): a, c, t, g, unknown or other
  modified_base (405)..(405): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcagggcattagctatttcttagcctggtancagacaaaaacagggaaacncccctaagctctgatctatgctgctatccctatttgacaaacgtggacgtcccatcgaaggttcaggcgacagtggatcgagggacagtaattcactctacacaatcagcagcctgcagcctagaaacgttnttttacggaacttaaactttatactgtaacaaactagtactttaatacttactcccgtggtaacgttcggaccgaaagggaccgaaaggtacggaaaacttcgaaaacgtaacgtggtcggtactcgacctaaccttaagttcc

SEQ ID NO: 410717 - DNA, 529 bp, Homo sapiens
  misc_feature: GZ8MTXP01CT2WV.51.61.F06.1.454.CMB.2.raw
  modified_base (253)..(253): a, c, t, g, unknown or other
  modified_base (274)..(274): a, c, t, g, unknown or other
  modified_base (400)..(400): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcagggcattagctatttcttagcctggtancagacaaaaaccagggaaacncccctaagctcctgatctatgctgcatcccatttgacaaactggatccatcaaggtcagcggacagtggatcgtagggacagaacttcactctacaacaatcagcagtcctgcagcctagaaagtnttttggacttaaatttatactgtaccaaatgtacttaatacttatcccgtggtaacgttcggaccgtaaagggacctaaagggtgaaaacttcaaaacggtaactagggtgactgacctaaccttgtcg

SEQ ID NO: 410718 - DNA, 546 bp, Homo sapiens
  misc_feature: GZ8MTXP01DK7LM.51.61.F06.1.454.CMB.2.raw
  modified_base (349)..(349): a, c, t, g, unknown or other
  modified_base (430)..(430): a, c, t, g, unknown or other
  modified_base (538)..(538): a, c, t, g, unknown or other
tcagcgatcgtatacacgaccggtgctcgatttagctacgctctaagggaaagggggagtcagtcccagtcaggacacatcatggacatgagggtccccgctcagctcctggggctcctgctgctctggctcccaggtgccagatgtgacatccagttgacccagtctccatccttcctgtctgcatctgtaggagacagagtcacatcacttgccggcagtcagggcattagctatttcttagcctggtatcagacaaaaaccgagggaaagccccctaagctcctgatctacgctgcatccactttgacaaactggacgtcccatccaaggttcagcggcaagtggntcgtgggacagaattcactctcacaatcagcagcctgcagccttagaagtattttgactaaactttattactgtacaaacngtactttaaattcttaatcccgtacgggtcgttaacggaccgttaaaggggacccaaagggttacggaaattaccgaaacgttaacgtggtaggcctgccttaacctnttccgttg

SEQ ID NO: 410719 - DNA, 595 bp, Homo sapiens
  misc_feature: GZ8MTXP01DWPK2.51.61.F06.1.454.CMB.2.raw
  modified_base (252)..(252): a, c, t, g, unknown or other
  modified_base (414)..(414): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcagggcattagctatttcttagctggtancaagacaaaacgaggaaacgcccctaagctctgatctatgctgctactcctaatttgactaaacgtggactacccatacgaaggttcaggcggacagtggatcgtagggacagtaacttcactctacaacaatcaagcagcctgacagacctaggtaaactntttttacggaactttaaactttaattactagtaaccaaactagttaacctttaaattactttacgtacccgttcgggtaaccgtttcgggaacccggtaaaggggaacccgtaaagggttaacgggaaaacttaacgaaaacggtaacgtggtcggactacgacctaacccgttaagtttc

SEQ ID NO: 410720 - DNA, 571 bp, Homo sapiens
  misc_feature: GZ8MTXP01A1FD3.51.61.F06.1.454.CMB.2.raw
  modified_base (196)..(196): a, c, t, g, unknown or other
  modified_base (254)..(254): a, c, t, g, unknown or other
  modified_base (275)..(275): a, c, t, g, unknown or other
  modified_base (372)..(372): a, c, t, g, unknown or other
  modified_base (404)..(404): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccgggcagtcagggcattagctatttcttagcctggtancagacaaaaacgagggaaacncccctaagctcctgatctatgctgctatccatttgacaaacgtggactcccatcgaagtcagcgacaggtgatcgagggacagattcactctacaanaatcagcacgcctgacagtcctaggaaagttntttcggaacttaactttattactgtacaaactagttacttaaactaccttacgtcccgttcgggtaacgttacggaccggtaaacgggaccgtaaaggggtaacgaaaacgttaccgttaaaacggtaacgttggtaacggaccttgaccctaaccgttaatttccg

SEQ ID NO: 410721 - DNA, 528 bp, Homo sapiens
  misc_feature: GZ8MTXP01CEED5.51.61.F06.1.454.CMB.2.raw
  modified_base (254)..(254): a, c, t, g, unknown or other
  modified_base (277)..(277): a, c, t, g, unknown or other
  modified_base (381)..(381): a, c, t, g, unknown or other
  modified_base (406)..(406): a, c, t, g, unknown or other
  modified_base (420)..(420): a, c, t, g, unknown or other
  modified_base (432)..(432): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagctatttcttagcctggtancaagacaaaaaccgagggaaacnccccctaagcctcctgatctatgctgcatcccatttgacaaactggactcccatcaaggttcaggcggacaggtggatcgtagggacagtacttcactctacanaatcagcagcctgcagctagaagtntttggacttaattntactgtacaagntacttaatcttatccgtacggaacgttcggacgaaacgggacgaaagggtagaaacttacgaaacgtaacgtggtaacggctggacctcgaattcg

SEQ ID NO: 410722 - DNA, 589 bp, Homo sapiens
  misc_feature: GZ8MTXP01EMHW4.51.61.F06.1.454.CMB.2.raw
  modified_base (383)..(383): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttggccggcagtcagggctattagctatttcttagcctggtatcaagacaaaaaccgagggaaaccccctaagctctagatctatgctgctatcccatttgactaaacgtggactcccaatcgaagttcaggtcgacaggtggatcgtagggacagtaattcactctacanaatcagcagcctgcagcctagtaactattttacggacttaaactttattactagtaacaactagttaactttaatactttacgtaccgttcgggaaccgtttccgggaaccggaaacggggttaaaccgaaacggggtaagttaaaacggttaccaaaacggtaacgtgggttaagccgttacggacctaaccgttaagtttcccg

SEQ ID NO: 410723 - DNA, 553 bp, Homo sapiens
  misc_feature: GZ8MTXP01DC229.51.61.F06.1.454.CMB.2.raw
  modified_base (196)..(196): a, c, t, g, unknown or other
  modified_base (253)..(253): a, c, t, g, unknown or other
  modified_base (267)..(267): a, c, t, g, unknown or other
  modified_base (275)..(275): a, c, t, g, unknown or other
  modified_base (374)..(374): a, c, t, g, unknown or other
  modified_base (390)..(390): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccattccttctgtctgcatctgtagganacagatcaccatcacttgccgggccagtcagggcattagctatttcttagctggtancaagacaaaaacgngggaaacncccctaagctctgatctatgctgctatcctatttgactaaacgtggactccatacgaaggttcaggcgaacagtgatcgagggacagtacttcactcanacaagcagcacgtccngcctaggcctagtaagttattttacggacttaaactttattaactagtaccaaatattactttaaacttcttacgtccgtacggtaacgttcggaccggtaaaggaccgaaaggtagaaacgttacgaaacgtaagtgtcggactgacctaacgttaagttcc

SEQ ID NO: 410724 - DNA, 511 bp, Homo sapiens
  misc_feature: GZ8MTXP01AR1M9.51.61.F06.1.454.CMB.2.raw
  modified_base (254)..(254): a, c, t, g, unknown or other
  modified_base (267)..(267): a, c, t, g, unknown or other
  modified_base (372)..(372): a, c, t, g, unknown or other
  modified_base (398)..(398): a, c, t, g, unknown or other
  modified_base (445)..(445): a, c, t, g, unknown or other
  modified_base (494)..(494): a, c, t, g, unknown or other
tcagcgatcgtatacacgaccggtgctcgatttagctacgctctaagggaaagggggagtcattcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagctatttcttagcctggtancaagacaaaacgnggaaacgcccctaagctctgatctatgctgcatccatttgacaaacgtggactccatctaaggtcagcggacaggtgatcgtagggacagtaactcactctacanaatcagcagcctgcagctagtaagtnttttacggacttaatttatactagtacaactgtaacttaatacttanccggtggtaacgtcggacgaagaccgaaggtaagaagcaacgtaagtgnggcagcaaccgttgttc

SEQ ID NO: 410725 - DNA, 549 bp, Homo sapiens
  misc_feature: GZ8MTXP01BTW0K.51.61.F06.1.454.CMB.2.raw
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagcatttcttagcctggtatcaagacaaaaaccgagggaaacgcccctaagctcctgatctatgctgcatcccatttgacaaacgtggacgtcccatcaaggttcagcggacagtgatcgtgggacagaattcaactctacaacaatcaagcaacgcctagcctaagcctagaaagttcttttagaacttaactttatacgtataacaactagttacttaatcttacgtccgtcggtaaccgttcggacgtaaagggacgtaaagggtaagaaacttacgaaacggtaactggtcggctacgacctaacgttgtcg

SEQ ID NO: 410726 - DNA, 565 bp, Homo sapiens
  misc_feature: GZ8MTXP01EWDBD.51.61.F06.1.454.CMB.2.raw
  modified_base (254)..(254): a, c, t, g, unknown or other
  modified_base (275)..(275): a, c, t, g, unknown or other
  modified_base (407)..(407): a, c, t, g, unknown or other
  modified_base (430)..(430): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagatcaccatcacttgccgggccagtcagggcattagctatttcttagcctggtancagacaaaaacgagggaaacncccctaagctcctgatctatgctgctatccctatttcgactaaacgtggacgtcccatcgaaggtcagcggacagtggatcgtagggactagtaattcactcacacatcagcacgctagcagcctagtaatntttaggacttaacttattacgtntacaaactcgtaacttaaatcttaactccgtcgggtaacttacgggacgaaacgggttaccgaaagggttaacggaaacttacgaaaacggtaacgttggtaacggacgtcggacctaacccgttaatttcccgg

SEQ ID NO: 410727 - DNA, 554 bp, Homo sapiens
  misc_feature: GZ8MTXP01BG250.51.61.F06.1.454.CMB.2.raw
  modified_base (253)..(253): a, c, t, g, unknown or other
  modified_base (274)..(274): a, c, t, g, unknown or other
  modified_base (432)..(432): a, c, t, g, unknown or other
  modified_base (534)..(534): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcagggcattagctatttcttagcctggtancagacaaaaaccagggaaacncccctaagctcctgatctatgctgctatccctatttgacaaactggatcccatcaaggtcagcggacagtggatcgtgggacagattcactctacacaatcagcagcctagcaagcctagaagttattttggacttaattatacctagtaccaaactntacctttaaatccttaatcccgtcgggtaaccgtttcgggaaccgtaacggggaaccgtaaaggggtaagaaaacgttcgaaaaccgtaagttcggcgtacngttacccaaccttaagtttc

SEQ ID NO: 410728 - DNA, 673 bp, Homo sapiens
  misc_feature: GZ8MTXP01CB2FI.51.61.F06.1.454.CMB.2.raw
  modified_base (200)..(200): a, c, t, g, unknown or other
  modified_base (255)..(255): a, c, t, g, unknown or other
  modified_base (276)..(276): a, c, t, g, unknown or other
  modified_base (288)..(288): a, c, t, g, unknown or other
tcagcgatcgtatacacgaccggtgctcgatttagctacgctctaaggggaaagggggagtcagtcccagtcaggacacagcatggacatgagggtccccgctcagctcctggggctcctgctgctctggctcccaggtgccagatgtgacatccagttcgacccagtctccatcccttcctgtctgcatcgtgtagganacagagtcacatcacgtgccggcagtcagggcattagctatttcttagcctgtancaagacaaaaacgaggaaacnccctaagctacngactctatcgctgactacttaccctactttcgaactaaacgtggactaccccaagttaccgtaaaggttcgaaggccggaactagggtcgggactaccgggtagggaactaagtaacttccacttaccaacaaaccaatccgaagcaacggtccctagcctacgaccgtagtaaagttacttttacgaaactttaaacgtttacttaacctagttaaacccaaacttagtttaaacccttttaaagttacccttacggttacccccggtaaggggtaacccgttaccggaacgggaaaaccgggttaccgtaaaaggggttacggaaaaacgttaccttaaaacggtaacgttcggcggtactacgacctaaccttgtttaaccg

SEQ ID NO: 410729 - DNA, 590 bp, Homo sapiens
  misc_feature: GZ8MTXP01EU6HW.51.61.F06.1.454.CMB.2.raw
  modified_base (260)..(260): a, c, t, g, unknown or other
  modified_base (279)..(279): a, c, t, g, unknown or other
  modified_base (397)..(397): a, c, t, g, unknown or other
  modified_base (414)..(414): a, c, t, g, unknown or other
tcagcgatcgtatacacgaccggtgctcgatttagctacgctctaagggaaaggggggagtcagtcccagtcaggacacagcatggacatgagggtccccgctcagctcctggggctcctgctgctctggctcccaggtgccagatgtgacatccagttcgacccagtcctccatccttcctgtctgcattctgtaggagacagagtcaccatcacgttggccgggcagtcagggcattagctatttcttagcctggtancagacaaaaacgaggaacncccctaagctcctgatctatcgctgcatccctatttgactaaacgtcggactcccatcgtaaaggttcaggcggactagggtggatcgagggactaagtacttcactctacaactacncgacgctacgcctgacnctacgtaagtaagttatttacggaactttaacgtttatacgtataacaactattaactttaatacttaccgtccgtcggtaaccgtccggaccggtaacgggaaacgacggtaaagggttaaacttaaaccgttaacgtaaacgtcgtcgtacgacttacgtaaccttcgttaacg

SEQ ID NO: 410730 - DNA, 525 bp, Homo sapiens
  misc_feature: GZ8MTXP01BII1I.51.61.F06.1.454.CMB.2.raw
  modified_base (254)..(254): a, c, t, g, unknown or other
  modified_base (276)..(276): a, c, t, g, unknown or other
  modified_base (411)..(411): a, c, t, g, unknown or other
  modified_base (514)..(514): a, c, t, g, unknown or other
  modified_base (521)..(521): a, c, t, g, unknown or other
  modified_base (525)..(525): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccacgttgacccagtctccatccttcctgtctgcatctgtaggagacagagtcaccatcacttgccggcagtcagggcattagctatttcttagcctggtancagacaaaaaccgagggaaacncccctaagctcctgatctatgctgcatccctactttgactaaacgtggacgtcccatacaagggttcaggcggacaggtggatcgtagggacagaacttcactctacacaatcagcagcctgccagctaggactntttggactaactttatactgtacccaagtatacttaatgttactcgtcgtaacgtcgaccgaacgggacgaaaggtgaaacttcgaaagtaacgtgaaggtcncgactcncgtn

SEQ ID NO: 410731 - DNA, 554 bp, Homo sapiens
  misc_feature: GZ8MTXP01BRMD1.51.61.F06.1.454.CMB.2.raw
  modified_base (196)..(196): a, c, t, g, unknown or other
  modified_base (254)..(254): a, c, t, g, unknown or other
  modified_base (275)..(275): a, c, t, g, unknown or other
  modified_base (288)..(288): a, c, t, g, unknown or other
  modified_base (403)..(403): a, c, t, g, unknown or other
  modified_base (418)..(418): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccgggcagtcagggcattagctatttcttagcctggtancaagacaaaaacgaggaaacncccctaagctccngatctatgctgctatccctatttgactaaactggactccatcaaggttcagcgcagtggatcgtagggacagtaacttcactctacacaatcagcagcctgcagcctagaagttntttggacttaacttntactgacaagtacgtactttaatcttactccgtcggtaaccgttcggaccgtaaacgggttaccgtaaaggggtaacaaaacgttacgaaaacggtaacgttggtaacggtctacggacctaaccttaagtttccg

SEQ ID NO: 410732 - DNA, 523 bp, Homo sapiens
  misc_feature: GZ8MTXP01C2ZQZ.51.61.F06.1.454.CMB.2.raw
  modified_base (252)..(252): a, c, t, g, unknown or other
  modified_base (413)..(413): a, c, t, g, unknown or other
  modified_base (417)..(417): a, c, t, g, unknown or other
tcagcgatcgtatacacgaccggtgctcgatttagctacgctctaagggaaaggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcagggcattagctatttcttagcctggtancaagacaaaaaccgagggaaacgcccctaagctcctgactctatgctgcatccattgacaaactggactccatcaagttcagcggacagtggatcgtagggacagaattcactctacagaatcagcagcctgcagcctagaagtatttggacttaaatttntacngtaccaatatacttaaatactactccgtggtaacgttcggaccgaaagggaaccgtaaagggtacgaaattacaaacgtaactaggtcgatcgactaaccgttgtc

SEQ ID NO: 410733 - DNA, 585 bp, Homo sapiens
  misc_feature: GZ8MTXP01C13QJ.51.61.F06.1.454.CMB.2.raw
  modified_base (253)..(253): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcacatcacttgccgggccagtcagggcattagctatttcttagctggtancagcaaaaccagggaaacgcccctaagctcctgatctatgctgcatcccatttgacaaactggacgtcccatctaaggttcagtccgggacaggtggatcgtaggggacagtaattcactctacacaatcaagcaacgcctgaccagccctagtaaagttactttttagggaccttaaattttaattacctagttaccaaacgtagtaaccttttaaattaaccctttaactcccgttacggggtaaccgtttcgggacccgaaacgggttaaccgaaagggtaggttaaaacttcgaaacgtaacgtgtaaggctggacaaccgttaattc

SEQ ID NO: 410734 - DNA, 552 bp, Homo sapiens
  misc_feature: GZ8MTXP01A2Y59.51.61.F06.1.454.CMB.2.raw
  modified_base (258)..(258): a, c, t, g, unknown or other
  modified_base (536)..(536): a, c, t, g, unknown or other
  modified_base (549)..(549): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtcctccatccttcctgtctgcatctgtaggagacagagtcaccatcacttcggccgggccagtcagggcattagctatttcttagcctggtancagaacaaaaccgagggaacgcccctaagctacctgactctatgctgctactccctaactttcgacctaaacgtggacgtcccatacgtaaggtcagcggacagtggatcgtagggacaagtaattcactctacaacaatccaagcacgcctagcagtacctagaagtattttcgggacttaacttattactgtaccaatacgtaacttaattaccttactccgtgggtaaccgtcggacgaacgggactaaaggtagaaacttcaacgtaatgtcgntcgactaacgttntcg

SEQ ID NO: 410735 - DNA, 500 bp, Homo sapiens
  misc_feature: GZ8MTXP01BX18D.51.61.F06.1.454.CMB.2.raw
  modified_base (269)..(269): a, c, t, g, unknown or other
  modified_base (387)..(387): a, c, t, g, unknown or other
  modified_base (497)..(497): a, c, t, g, unknown or other
tcagcgatcgtatacacgaccggtgctcgatttagctacgctctaagggaaagggagtcagtcccagtcaggacacagcatggacatgagggtcccgctcagctcctggggctcctgctgctctggctcccaggtgccagatgtgacatccagttgacccagtctccatccttcctgtctgcatctgtaggagacagagtcaccatcacttgccgggcagtcagggcattagcatttcttagcctggtatcagcaaaaaccagggaaancccctaagctcctgatctatgctgcatccactttgcaaactggactcccatcaggttcagcggcagtgatcgtgggacagaattcactctacacatcagcagcctgcagcctgaagtnttttggactaatttattactgtacaactagtacttaatacttatcctcggaacgttcggacctaaagggaccaaagggtaggaaattcaaacgaactgtggctgctaacntcg

SEQ ID NO: 410736 - DNA, 692 bp, Homo sapiens
  misc_feature: GZ8MTXP01AGTT7.51.61.F06.1.454.CMB.2.raw
  modified_base (259)..(259): a, c, t, g, unknown or other
  modified_base (279)..(279): a, c, t, g, unknown or other
tcagcgatcgtatacacgaccggtgctcgatttagctacgctctaagggaaaggggagtcagtcccagtcaggacacagcatggacatgagggtccccgctcagctcctggggctcctgctgctctggctcccaggtgccagatgtgacatccagttgacccagtctccatccttcctgtctgctatcgtggtaggagacagacgtcacatctacgtcggcccggacagtcgaggctatagcttatttctagcgtgtancagaacaaaacgaggaaccncccctaagcctacgtgtactctagtcgctgctactacctagtttcgactaaacgtcggtacgtcctacgtacgtaaggtccgaggccgacgtaggtggactcgggagggacaagttacttacacttccacaactactacgacgacacgtcctagaccgacgtctaaggtaagtttacgtttacgggaaacctttaaacgtttacgttaaccgtacgttaacccaaacgttaacgttaacttttaaaccttaacctttacccgtacccggttaacggggtaaccccggttccgggaaacccggtaaacggggttaaacccggtaaggggttaaacgttaaaaccgttaaccgaaaacccgggttaagtagggtaaccggtacccgtacggacccctaacccgttaatttcccgg

SEQ ID NO: 410737 - DNA, 558 bp, Homo sapiens
  misc_feature: GZ8MTXP01BJORG.51.61.F06.1.454.CMB.2.raw
  modified_base (257)..(257): a, c, t, g, unknown or other
  modified_base (276)..(276): a, c, t, g, unknown or other
  modified_base (343)..(343): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttcgacccagtctccatccttcctgtctgcatctgtaggagacagagtcacatcacttcggccggcagtcgagggctattagctatttcttagcctggtancagaacaaaacgaggaacnccctaagctctgatctatgctgctactcctatttgactaaacgtggactccatacgtagtcagcganagtgatcgagggacagtacttcactcacataactcagcacgcctgacacgactagtaagttactttagggaacttaaactttacttacgtagttaaccaaacgttataactttaataccttactcccggtaggtaacggtaccgacggaaacggacgtaaagggtacgaaacttacgaaacgtaacgtggcgacgtacgacctaaccttgttccg

SEQ ID NO: 410738 - DNA, 516 bp, Homo sapiens
  misc_feature: GZ8MTXP01B959N.51.61.F06.1.454.CMB.2.raw
  modified_base (251)..(251): a, c, t, g, unknown or other
  modified_base (263)..(263): a, c, t, g, unknown or other
  modified_base (392)..(392): a, c, t, g, unknown or other
  modified_base (407)..(407): a, c, t, g, unknown or other
  modified_base (493)..(493): a, c, t, g, unknown or other
  modified_base (499)..(499): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtcctccatccttcctgtctgcatctgaggagacagatcacatcacttgccggcagtcagggcattagctatttcttagcctggtancagacaaaacgnggaaacgcccctaagctctgatctatgctgcatccactttgactaaactggacgtccatacaggttcaggcggcaggtgatcgtagggacagaattcactctacacatcagcacgctgcagctgaagtntttggactaacgttntactgtacaacagtacttaatacttactccgtcggtaacgttcggaccggaaagggaccgtaaagggtgaaagttcaaacgtaacngtgacngactaaccgttaattcc

SEQ ID NO: 410739 - DNA, 548 bp, Homo sapiens
  misc_feature: GZ8MTXP01E00IT.51.61.F06.1.454.CMB.2.raw
  modified_base (278)..(278): a, c, t, g, unknown or other
  modified_base (350)..(350): a, c, t, g, unknown or other
tcagcgatcgtatacacgaccggtgctcgatttagctacgctctaagggaaaggggggagtcagtcccagtcaggacacagcatggacatgagggtccccgctcagctcctggggctcctgctgctctggctcccaggtgccagatgtgacatccagttgacacagtctccatccttcctgtctgcatctgtaggagacagagtcaccatcacttgccgggcagtcagggcattagctatttcttagcctggatcaagacaaaaaaccgagggaaacncccctaagctcctgatctatgctgcactcctactttgacaaactggactccccccatcaaggttcaggcgcngtggatcgtagggacagaacttcactctacacaatcagcagcctgcagctagaagtattttgactaattagtactgacaactagtcttaaatcttactcccgtaacgggtacgtttcggaccgttaaacggggaaccgtaaagggttacggaaaacttacgaaaacgtaactggtcgggacttcgtaaccaaccgtaa

SEQ ID NO: 410740 - DNA, 565 bp, Homo sapiens
  misc_feature: GZ8MTXP01CNYIM.51.61.F06.1.454.CMB.2.raw
  modified_base (255)..(255): a, c, t, g, unknown or other
  modified_base (277)..(277): a, c, t, g, unknown or other
  modified_base (443)..(443): a, c, t, g, unknown or other
  modified_base (459)..(459): a, c, t, g, unknown or other
  modified_base (560)..(560): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttggccggccagtcgagggcattagctatttcttagctggtancagacaaaaaccgagggaaacnccctaagctcctgactctatgctgctatcctattgactaactggactccatactaaggttcaggcggacaggtggactcggtaggggactaggtaacttcaactcctacaactaatcagtcaacgtcctgacagtcctagtaacgtattttcggacttaaactttnttactgtacaaacgtntactttaataccttactccgttcggtaacgttcggaccgtaaacgggaaccgaagggttaagaaacgttacgaaacgtaagtgttcggctcggactaaccngttcc

SEQ ID NO: 410741 - DNA, 519 bp, Homo sapiens
  misc_feature: GZ8MTXP01C5NHM.51.61.F06.1.454.CMB.2.raw
  modified_base (254)..(254): a, c, t, g, unknown or other
  modified_base (276)..(276): a, c, t, g, unknown or other
  modified_base (516)..(516): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcacatcacttgccgggccagtcagggcattagctatttcttagcctggtancagacaaaaaccgagggaaacnccccctaagctcctgatctatgctgcatccattgacaaactggatcccatcaaggtcagcggacagtggatcgtagggacagaattcactctcacaatcagcagcctgcagctgaagtattttggactaatttatactgtacaacagtacctttaaatcttactccgtcgggtaacgttcggaccgaaagggaccgaagggtaggaaacttcaaaacgtaactggtcggctgactaaccntcg

SEQ ID NO: 410742 - DNA, 529 bp, Homo sapiens
  misc_feature: GZ8MTXP01A7M1R.51.61.F06.1.454.CMB.2.raw
  modified_base (255)..(255): a, c, t, g, unknown or other
  modified_base (277)..(277): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagctatttcttagcctggtancagacaaaaaccgagggaaacncccctaagctcctgatctatgctgcatccactttgacaaactggactccatcaggttcagcggacagtggatcgtgggacagaattcactctacacaatcagcagcctgcagcctagagtatttggactaacttatactgtcaacatacttaatacttactccgtcggaacgttcggaccgtaaacgggaccgtaaaggtaggaaacttccgaaaacgaacctggtcggtcaggactaacccgaagttcccg

SEQ ID NO: 410743 - DNA, 659 bp, Homo sapiens
  misc_feature: GZ8MTXP01DSHD7.51.61.F06.1.454.CMB.2.raw
  modified_base (253)..(253): a, c, t, g, unknown or other
  modified_base (270)..(270): a, c, t, g, unknown or other
  modified_base (289)..(289): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatcgtgtaggagacagagtcacatcacttgccggcagtcgagggcattagctatttcttagctggtancagacaaaacaggaacncccctaagctctgatctangctgcacttcctactttgactaaacgtggactacccaatacgtaaaggttcaacgtcggaactaggtcgggatcgtagggaacaggtaacttcactctacgaacaatcgaagtcaacggccctaggaccctagacccgtaggtaaacgttacgtttttacggaacttaaacgttttattaaccgtagtaacctaaaacgttacgtaaccttttaaacgttaacctttacgtacccggttacggggtaacccgtttcggggaaacccggttaaaacggggaaaccgtaaacggggtaaggaaaaaccttacggaaaaaccggtaacgttagggttcgggtactacggaccttaaaccgttcgttttaaccg

SEQ ID NO: 410744 - DNA, 529 bp, Homo sapiens
  misc_feature: GZ8MTXP01EVDSX.51.61.F06.1.454.CMB.2.raw
  modified_base (252)..(252): a, c, t, g, unknown or other
  modified_base (264)..(264): a, c, t, g, unknown or other
  modified_base (342)..(342): a, c, t, g, unknown or other
  modified_base (510)..(510): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcagggcattagctatttcttagctggtancagacaaaacgnggaacgcccctaagctctgatctatgctgcatcccatttgacaaactggactccatcaaggtcagcgacagtgatcgngggacagaatcactctcacatcagcacgcctgcagcctagaagtatttcggacttaacttattactgtacaaactagtactttaaactactttatcccgtcggaacgttcggacgtaacgggaaccgaaagggtaacggaaagttacaaacgtaagtcgtaaggtcgngacctaacgttaacgttcg

SEQ ID NO: 410745 - DNA, 567 bp, Homo sapiens
  misc_feature: GZ8MTXP01A6KPR.51.61.F06.1.454.CMB.2.raw
  modified_base (254)..(254): a, c, t, g, unknown or other
  modified_base (266)..(266): a, c, t, g, unknown or other
  modified_base (272)..(272): a, c, t, g, unknown or other
  modified_base (284)..(284): a, c, t, g, unknown or other
  modified_base (376)..(376): a, c, t, g, unknown or other
  modified_base (564)..(564): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagctatttcttagcctggtancagacaaaacgnggaacncccctaagctcngatctatgctgcatcccatttgactaaactggactccatcaaggtcagcgacagtgatcgtagggactagtaactcaactctacacgtaacncacgcacgtcctagcacgtcgtaagtaacgtttactttacggaactttaaacgtttactacctacgtaactaacgttattaactttaacttaccgttacgtcccggtacggtaaccggttacggaaccggtaaacgggacgtaaaggtacgaaacgttacgaacggtgtgcggctacgactaacgttntcg

SEQ ID NO: 410746 - DNA, 495 bp, Homo sapiens
  misc_feature: GZ8MTXP01BF35C.51.61.F06.1.454.CMB.2.raw
  modified_base (279)..(279): a, c, t, g, unknown or other
  modified_base (376)..(376): a, c, t, g, unknown or other
  modified_base (401)..(401): a, c, t, g, unknown or other
  modified_base (412)..(412): a, c, t, g, unknown or other
  modified_base (435)..(435): a, c, t, g, unknown or other
  modified_base (480)..(480): a, c, t, g, unknown or other
  modified_base (488)..(488): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttcgacccagtctccactccttcctgtctgcatctgtaggagacagagtcaccatcacttgccggcctttttttagcaggcattagcatttcttagcctggtatcagacaaaaccagggaaancccctaaagctcctgatctatgctgcatcccacttttgactaaactggagtcccatcaaggttcagcgacagtggatcgtgggacagtatcactctnacaatcagcagcctgcagctgaatntttgctaattntatgcaatgtacttaatacttancctgggaacttcggactaagggacaaaggtgaaattcaaagctgngctgaccncttaatc

SEQ ID NO: 410747 - DNA, 614 bp, Homo sapiens
  misc_feature: GZ8MTXP01B8ROJ.51.61.F06.1.454.CMB.2.raw
  modified_base (252)..(252): a, c, t, g, unknown or other
  modified_base (273)..(273): a, c, t, g, unknown or other
  modified_base (295)..(295): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcacatcacttgccgggcagtcagggcattagctatttcttagctggtancagacaaaaacgagggaaacncccctaagcctctgactctatnctgcactcctactttacgacaaacgtcggactccctaagttaccgaaaggttcaggcggacgtaggtgggatcggtagggactagtaacttcactctacaactactcgagcaacgcctagccacgtcctaaggtaacgttacttttcggaactttaaactttcttaacgtacgtaacctaaacgtatttaacctttaaacttaccgttaaccgtcccgttaccgggtaaccgttcggggacccgtaaacggggaaccgtaaagggtaacgttaaacgttacgaaacgtaactggtaacggctacgactaacttcgttcg

SEQ ID NO: 410748 - DNA, 580 bp, Homo sapiens
  misc_feature: GZ8MTXP01DZOK8.51.61.F06.1.454.CMB.2.raw
  modified_base (198)..(198): a, c, t, g, unknown or other
  modified_base (261)..(261): a, c, t, g, unknown or other
  modified_base (281)..(281): a, c, t, g, unknown or other
  modified_base (420)..(420): a, c, t, g, unknown or other
  modified_base (443)..(443): a, c, t, g, unknown or other
tcagcgatcgtatacacgaccggtgctcgatttagctacgctctaagggaaaggggggagtcagtcccagtcaggacacagcatggacatgagggtccccgctcagctcctggggctcctgctgctctggctcccaggtgccagatgtgacatccagttgacccagtctccatccttcctgtctgcatctggtagganacagagtcaccatcacgttcggcccgggcagtcgagggctattagctatttcttagctggtancaagaacaaaacgaggaacncccctaagctctgatctatgctgctatccctatttgacaaacgtggacgtccatacgtaaggtcaggcggacaggtcggatcgtagggactaagtacttcactcacaacgaatcaagcacgcctgcagctagtaaattntttacggaacttaatttatactntaaccaatacgttaacttaacttacgttactacccggttggggtaaccgttcgggaaccggtaaacgggaaccgtaaagggttaaggaaacttacggaaaacgtcgtaggtcggcgtagacctaaccgttcgttccg

SEQ ID NO: 410749 - DNA, 571 bp, Homo sapiens
  misc_feature: GZ8MTXP01DJMQ9.51.61.F06.1.454.CMB.2.raw
  modified_base (256)..(256): a, c, t, g, unknown or other
  modified_base (274)..(274): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctcattccttcctgtctgcatctgtaggagacagagtcacatcacttcgccgggcagtcgagggctattagctatttcttagcctggtancagacaaaacgaggaacncccctaagctctgattctatcgctgctacttcctatttgacctaaacgtggactcccaagtacgtaaggttcaggcggactagtggatcgtagggactagtattcactctacaactatcagcagctagacagctagtaattctttaggacttaatttatactcgtacaatacgttactttaaactctttacgccggttacggtaacgttcgggaacgtaaacgggaaccgtaagggtaggaaaaccttcgaaaaaccggttctagggtcgtacgtacgttacctaacgttaagttcc

SEQ ID NO: 410750 - DNA, 608 bp, Homo sapiens
  misc_feature: GZ8MTXP01BQIFK.51.61.F06.1.454.CMB.2.raw
  modified_base (197)..(197): a, c, t, g, unknown or other
  modified_base (253)..(253): a, c, t, g, unknown or other
  modified_base (276)..(276): a, c, t, g, unknown or other
  modified_base (603)..(603): a, c, t, g, unknown or other
tcagcgatcgtatacacgaccggtgctcgatttagctacgctctaaggggaaagggggagtcagtcccagtcaggacacagcatggacatgagggtccccgctcagctcctggggctcctgctgctctggctcccaggtgccagatgtgacatccagttgacccagtctccatccttcctgtctgcatctgtagganacagatcacatcacttggccggcagtcagggcattagctatttcttagcctggtancaagacaaaaaccgagggaaacncccctaagctacctgatctagtgctgctactccctactttgacctaaacgtcgacgtcccagtcgaaggttcgaggcggacagggtgatcgtagggactagtacttcactctacaacaatcgagcacgcctgacacgtctagtaattcgtttagaacctttaaacgtttataacgttgtaaacctaacgtacgtaaccttttaaacttacctttacgtccccggtaacgggtaacccggttacgggaaccgtaaaacggggaccgtaaagggtaacggttaaaacttccgaaaaaggttccgtaggtcggacctagacctaacgttnttccg

SEQ ID NO: 410751 - DNA, 574 bp, Homo sapiens
  misc_feature: GZ8MTXP01AQ6KO.51.61.F06.1.454.CMB.2.raw
  modified_base (257)..(257): a, c, t, g, unknown or other
tcagcgatcgtatacacgaccggtgctcgatttagctacgctctaagggaaaggggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttcggccgggcagtcagggcattagctatttcttagcctggtancaagacaaaaccgaggaaacgcccctaagctcctgactctatcgctgactactccctactttcgactaaacgtggactaccagtaccgaaggttcaggcgacgagtgagtcgtagggactagtactcactctacacaatcgagctacgcctgcacgctaagtaacgttatttacgggacttaaatttactacgtagtacaactacgttaactttaataccttagtcccgtgggtaaccgtcggaccggtaaacggaccgtaaagggtacgaaacgttacgaaacggtaacgtggtcggctacgactaaccgttgtcg

SEQ ID NO: 410752 - DNA, 632 bp, Homo sapiens
  misc_feature: GZ8MTXP01APLU8.51.61.F06.1.454.CMB.2.raw
  modified_base (258)..(258): a, c, t, g, unknown or other
  modified_base (280)..(280): a, c, t, g, unknown or other
  modified_base (301)..(301): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtcctccattccttcctgtctgcatctggtaggagacagagtcaccatcacttcggccgggcagtcagggcattagctatttcttagctggtancaagacaaaaccgagggaaacnccctaagctctgactctagtnctgactatccctatttgactaaacgtggactaccataccgaggttcaggcgacgagtggatcgtagggacagtaacttcactctacaactatccgagcagcctagacagcctaaggtaatattttacggaactttaacgttattaaccgtataactaaacgtactttaactttaaacttaccgttacgtaccccgttacggggttaacccgttacggggttaaccggaaaccgggttaaaccgggtaaagggtaaacgttaaaaccgttaaccgaaaacgggtaacgttgggtaaccggttacgtcggaacctaacccgtttcgttaaccg

SEQ ID NO: 410753 - DNA, 588 bp, Homo sapiens
  misc_feature: GZ8MTXP01EQR6Z.51.61.F06.1.454.CMB.2.raw
  modified_base (256)..(256): a, c, t, g, unknown or other
  modified_base (409)..(409): a, c, t, g, unknown or other
tcagcgatcgtatacacgaccggtgctcgatttagctacgctctaagggaaaggggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagctatttcttagcctggtancaagacaaaacagggaaacgcccctaagctcctgatctatgctgcactcctactttgactaaacgtggacgtccaatcgtaaagtcgagcggtacaggtggatcgagggacagtaactcactctacacatcagcacgctgcagctagaagttntttcggaacttaattacttactacgtaacaaacgtattaacttaattaccttacgtcccgtacgggttaaccggttacggaacccggtaaacgggttaaaccggtaaagggtaacggttaaaacgttacgaaaaccggtaagttcgggtaacggctacgacctaaccttcgtttaaccg

SEQ ID NO: 410754 - DNA, 648 bp, Homo sapiens
  misc_feature: GZ8MTXP01DLEXA.51.61.F06.1.454.CMB.2.raw
  modified_base (197)..(197): a, c, t, g, unknown or other
  modified_base (278)..(278): a, c, t, g, unknown or other
  modified_base (442)..(442): a, c, t, g, unknown or other
  modified_base (641)..(641): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttcgacccagtctccatccttcctgtctgcatctgtagganacagagtccacatcacgttcggccgggcagtcgagggcattagctatttcttacgctggtatcaagacaaaacgaggaacnccctaagctctgatctatcgctgactactcccttacgtttacgactaaacgtcggacgtccctaagtacgtaaggttcgaaggccggaactaggtggtatcggtagggactagtacttcactctacatactcagtcacgcctagactagacctagtaaacgttnttttacggaactttaacgttaacttacgagtaacctaaagttacgttaaacttttaaacttaccctttacgttacccgggtttaccgggaaaccggttttaccgggaaacccgggtaaaaggggttaacccgtaaaggggtaaccgttaaaacgaccgttaaacggtaacggtggttaacggcctagaccctaacgttnttaaccg

SEQ ID NO: 410755 - DNA, 592 bp, Homo sapiens
  misc_feature: GZ8MTXP01AZI2E.51.61.F06.1.454.CMB.2.raw
  modified_base (198)..(198): a, c, t, g, unknown or other
  modified_base (258)..(258): a, c, t, g, unknown or other
  modified_base (277)..(277): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttcgacccagtcctccatccttcctgtctgcatctgtagganacagagtcaccatcacttcggccgggcagtcgagggctattagctatttcttagctgtancagaacaaaacgaggaacnccctaagctctgactctatcgctgactactcctatttcgactaaacgtcggactcccatacgaaggttcaggcggacaggtggactcggtagggaactagtaaacttccacttcctacaactaactcaacgcgaacgccgtagaccacgtccgttaagtaacgtttatttacggaacttaactttagttactacgtaacaaacgtattaacttaaattaccttacgtccgtacgggtaacgttacggacggaaacggaccgtaaaggtaagaaacttacgaaacgtaacgtggccgctaccactgttcgttaacg

SEQ ID NO: 410756 - DNA, 602 bp, Homo sapiens
  misc_feature: GZ8MTXP01A12QL.51.61.F06.1.454.CMB.2.raw
  modified_base (196)..(196): a, c, t, g, unknown or other
  modified_base (253)..(253): a, c, t, g, unknown or other
  modified_base (273)..(273): a, c, t, g, unknown or other
  modified_base (387)..(387): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacgttgccggcagtcagggcattagctatttcttagctggtancagacaaaacgagggaaacncccctaagctcctagatctatgactgctactcctactttcgacaaacgtcggtactccactacgtaggtcgagcggaacaggtggacgtcgtagggacagtaactctactctanaactactcaacgctacgctacgacagtacctagtaacgttattttcggaacttaactttaactacgtataaccgtaatacgttaactttaaacgttcctttaacgtcccggtacgggtaaccggttacgaaccggtaaacgggaacgtaaagggtaacggttaaacttacgaaacggtaacgtggtaacggctaggacctaacgttaacgttccg

SEQ ID NO: 410757 - DNA, 525 bp, Homo sapiens
  misc_feature: GZ8MTXP01BUR5D.51.61.F06.1.454.CMB.2.raw
  modified_base (198)..(198): a, c, t, g, unknown or other
  modified_base (257)..(257): a, c, t, g, unknown or other
  modified_base (275)..(275): a, c, t, g, unknown or other
  modified_base (288)..(288): a, c, t, g, unknown or other
  modified_base (367)..(367): a, c, t, g, unknown or other
  modified_base (502)..(502): a, c, t, g, unknown or other
  modified_base (521)..(521): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttcgacccagtcctccatccttcctgtctgcatctgtagganacagagtcaccatcacttggccgggcagtcagggcattagctatttcttagcctggtancagacaaaacgaggaacncccctaagctccngatctatgctgctatcctactttgactaacgtggactccatcaagtcagcgacagtgatcgagggactagatcactcanacatcagcagcctgcagctagaagttattttacggacttaaatttctaacttgaacctaacgtattaacctttaatcttacgtcccgtaggtaacgttcggacgaaagggaccaagggtacaaagttcaaacgtntgtaaggcagctaaccttntccg

SEQ ID NO: 410758 - DNA, 661 bp, Homo sapiens
  misc_feature: GZ8MTXP01EZQLJ.51.61.F06.1.454.CMB.2.raw
  modified_base (255)..(255): a, c, t, g, unknown or other
  modified_base (278)..(278): a, c, t, g, unknown or other
tcagcgatcgtatacacgaccggtgctcgatttagctacgctctaagggaaaggggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagatcacatcacttggccggcagtcgagggctattagctatttcttagcctggtancaagaacaaaaacgagggaaacncccctaagcctacctgatctatcgctcgctactcctaactttgactaaacgtggacgtccaactacgtaaggtcaggcggacgaggtggtactcggtagggactagtaactttccactactacaacactacgaggctaacggcccttgacgtacgtaccgtagtaaacgttactttttacgggaactttaaactttaacgtttaacgtacgttaaacctaaacggtagtttaaaccttttaacgtttacgtttaaccgtcccggtttaccggggtaaaccgtttccggaaaccgtaaacggttaaccgaaaccggtaaagggttaacggttaaacttaaaccgaaacgtaacgtgtacgggtcacgtaacgttaacccttaag

SEQ ID NO: 410759 - DNA, 688 bp, Homo sapiens
  misc_feature: GZ8MTXP01C0AGI.51.61.F06.1.454.CMB.2.raw
  modified_base (252)..(252): a, c, t, g, unknown or other
  modified_base (273)..(273): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcacatcacttgccggcagtcagggctattagctatttcttagctggtancaagacaaaaacgaggaaacncccctaaagctcctagatctatgctgcactcctacttgactaaactggacgtcctaatcgtaaaggttcaggcggacagtgatcgtagggactagacttcactctacaacaatcagacagcccttggaccagtacctaaggtaaactttacgttttacgaacctttaaaactttaactttaacccgtaagttaaacctaaaacgtaacgtttaaccttttaaaactttaacccgtttaaccgtccccgggtttaaaccggggttaacggttttaaaccccggggaaacccgggtaaaacgggggttaaaccccgttaaaagggggtaaacggttaaaaaccttaacggaaaaaccggttaaaccgttggggttaaccggaccgttacggaaccctaaccccgttaattttcccgg

SEQ ID NO: 410760 - DNA, 583 bp, Homo sapiens
  misc_feature: GZ8MTXP01B2H0V.51.61.F06.1.454.CMB.2.raw
  modified_base (196)..(196): a, c, t, g, unknown or other
  modified_base (253)..(253): a, c, t, g, unknown or other
  modified_base (274)..(274): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccggccagtcagggcattagctatttcttagctggtancaagacaaaaccgaggaaacncccctaagctacctgatctatgctgcatcccatttgacaaacgtggatcccaatcgaagttcagcgacaggtgatcgtagggactagtacttcactctacaacaatcaagtcaacgcctgacagcctaggtaattatttggacttaaactttactactagtaacctaaacgtacgtttaaccttaaattccttacgtcccggttacggtaaccggttccggaaaccgtaaacgggaccgtaaaagggtacgttaaaacgttacgaaaacgtccgtggtaacggtctcgaccgtaacccttaagtttccg

SEQ ID NO: 410761 - DNA, 595 bp, Homo sapiens
  misc_feature: GZ8MTXP01B1WW8.51.61.F06.1.454.CMB.2.raw
  modified_base (255)..(255): a, c, t, g, unknown or other
  modified_base (276)..(276): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagctatttcttagcctggtancagacaaaaaccgagggaacncccctaagctcctgatctatgctgcatccctatttgacaaactggactccatcaggttcagcgacgagtggatcgtaggggacagtaacttcactctacaacatcagcagccctagcagaccctaggtaaagttattttacggacctttaaactttaacttacgttacgttaccaaactagttaacctttaaactacctttacgtcccggtaccgggtaaccgttccgggaccggtaaacgggaaaccgtaaaggggtaagaaacgttaaccgaaaacgtaacgttacggtcgggactcggacctaacttcgttaaccg

SEQ ID NO: 410762 - DNA, 865 bp, Homo sapiens
  misc_feature: GZ8MTXP01C8BPH.51.61.F06.1.454.CMB.2.raw
  modified_base (278)..(278): a, c, t, g, unknown or other
  modified_base (285)..(285): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccattccttcctgtctgcatctgtaggagacagacgtcacatcacgttcggccgggccagtcgagggctattagctattttcttagccttggtatacagaacaaaaacgnggaaacncccctaagctctgatctatcgctgctactcccgtatttcggacctaaacgtcggacgttacccctaagttaccgtaaacggtttccgaacggccgggtaaccgtaagggttcggggtaacttaccggggtttaacgggggaaacctaaacgggttaaaaccttttccgaaacccgttttaccgtaaacccgaaacggttaaacccgtaccgtaacggtacccggtaccggttacccgtacggaacccggtaaccggttaccggttaaaggtttaaacgttttaccgttttaacggggtaaaccttttaaaccgttttaacgtttaaaccgttaaccgttaaacctaaacgtttaacgttttaaaccttttaaacgtttaacccgtttacccggttaaccccgggtttaaccggggttaaacccgggtttaaccggggaaacccgggttaaaacggggttaaaccggtaaaacgggggttaaccgttaaaaaacgttaacccgggttaaaaaccgggttaacggttacgggttaaccggtaaccgttaccggttaacccttaaccgtttaacgtttaaccg

SEQ ID NO: 410763 - DNA, 536 bp, Homo sapiens
  misc_feature: GZ8MTXP01CFHZW.51.61.F06.1.454.CMB.2.raw
  modified_base (252)..(252): a, c, t, g, unknown or other
  modified_base (345)..(345): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttcgacccagtctccattccttcctgtctgcatctgtaggagacagatcacatcactgccggcagtcagggcattagctatttcttagcctggtancagacaaaacgaggaaacgcccctaagctcctgatctatgctgctatccctatttgactaaacgtggactcccaatcgtaaggttcagcgganaacgggtgatcgtagggactagtaacttcactctacaactaatcagcagccctgactagcctagtaatattttaggacttaaactttagtactagtacaactagtacttaattactactccgtcggtaacgtcgaccgaaaggacgaaggtagaacttacaaacgtaactggtgcctgactaacgttgttc

SEQ ID NO: 410764 - DNA, 545 bp, Homo sapiens
  misc_feature: GZ8MTXP01AWGTW.51.61.F06.1.454.CMB.2.raw
  modified_base (255)..(255): a, c, t, g, unknown or other
  modified_base (275)..(275): a, c, t, g, unknown or other
  modified_base (294)..(294): a, c, t, g, unknown or other
  modified_base (399)..(399): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccattctccatccttcctgtctgcatctgtaggagacagagtcaccatcacttggccgggcagtcagggcattagctatttcttagcctggtancagacaaaacgagggaaacncccctaagctctgatctangctgcatcccatttgactaaactggactccatcgaagtcgagcggacaggtgatcgtagggacagtaactcactctacacaatcagcagcctgcagctagaagtntttagactaatttatactgtaacactagttacttaaatccttacgtccgtcggtaacgttcggaccgaaacggggttaaccgtaaaggggtaacggaaacttcgaaaaacgtcgtggtaacggctacggacctaacgttaacttcg

SEQ ID NO: 410765 - DNA, 603 bp, Homo sapiens
  misc_feature: GZ8MTXP01AJ4VX.51.61.F06.1.454.CMB.2.raw
  modified_base (253)..(253): a, c, t, g, unknown or other
  modified_base (271)..(271): a, c, t, g, unknown or other
  modified_base (589)..(589): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttctgtctgcatctgtaggagacagagtcaccatcacttggccggcagtcgagggctattagctatttcttagctgtancagacaaaacgaggaacnccctaagctctgatctagtgctcgactactcctactttgactaaacgtcgacgtccagtacgtaggtcgacggcggaactagggtgtagtacggtagggacagtaactcctaacctctacaacaactcaacgcgtacgccgtgaccaacgtccgtaagtagtttacttaacgggtaacttaaacgtttactacgttactaccgtaaatagtttaaccttaaattccttaccgttacccggcggttaaccgggttacgaacgggtaacggttaaggtaacggtaacgaacgttaacgaacgtaagtggtaacgtcgacnctaacttcgttccg

SEQ ID NO: 410766 - DNA, 633 bp, Homo sapiens
  misc_feature: GZ8MTXP01BAYGK.51.61.F06.1.454.CMB.2.raw
  modified_base (264)..(264): a, c, t, g, unknown or other
  modified_base (287)..(287): a, c, t, g, unknown or other
tcagcgatcgtatacacgaccggtgctcgatttagctacgctctaaggggaaaggggggagtcagtcccagtcaggacacagcatggacatgagggtccccgctcagctcctggggctcctgctgctctggctcccaggtgccagatgtgacatccagttgacccagtctccattccttcctgtctgcattctggtaggagacagagtccaccatcacgttggccgggcagtcaggggctattagtctatttcttagctggtancaagaacaaaaccgagggaaacnccctaagctctgatctagtcgctgctactccctactttgacctaaacgtcggactaccaacgtaccgtaaggttcaggcggaactagggtcggatccggagggaactagtaacttcaactcctacaaacaactcgaagtcacggtcctgaccgagccttaaggtaaacttctttacggaactttaaacgtttacttacgtagtaacctaacgtaacgttactttaaactcctttaagtccccggtaggggttaaccctacgggacgtaaacgggaaccgtaaagggtaagaaaacttccgaaaacggtaacgttggaaccgttcgacgaccctaacgttcgtaacg

SEQ ID NO: 410767 - DNA, 627 bp, Homo sapiens
  misc_feature: GZ8MTXP01AHBN6.51.61.F06.1.454.CMB.2.raw
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttctgtctgcatctgtaggagacagagtcaccatcacgttgccggccagtcagggcattagctatttcttagctgtatcagacaaaacgaggaacgcccctaagctcctgtatctatcgctgctactcctactttcgacctaaacgtggactaccctaacgtactaagggttcacggtcggacagggtggacgtcgtagggactagtaacttcaactctacaacatcacgcgtacgcctagccgacgtacctaaggtaaactttagttttacgaaccttaaacgttttacttaacccgtagttaaccgaacgttaacgttaaccctttaaattaccgtttacgttacccggtcgggttaacccggttacggaccgggaaaacgggttacccgtaaagggttaacgaaacgttaccgaaacggtctaggtcgtactacgactaaccgcgtttcg

SEQ ID NO: 410768 - DNA, 646 bp, Homo sapiens
  misc_feature: GZ8MTXP01B7PZS.51.61.F06.1.454.CMB.2.raw
  modified_base (182)..(182): a, c, t, g, unknown or other
  modified_base (291)..(291): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttcgacccagtcctccattccttccngtctgcatcgtgtaggagacagacgtcacatcacgttgccggcagtcgagggcagttagcgtattttctttagccgtggtatcgaagtacaaaaaaccgagggaaaccnccccgtaaagccttccgtagaactcctatcgcttgacctactccctactttcgactaaacgtggacttacccacgtaccgaaggtttcacggtcggaacagggtcgaatccgtaggggaccaggtaacttcactactacgaactaatcgacgccaacgccttagccaggtaccgtagtaaacggttatttttacgggaactttaacgtttaacttacgtagtaccaacgtaacgttactttaaacttaccgtttactccggttacgggaaccctttcgggaaccgaacgggacgtaaagggtagttaaacgttcgaaacggtaaccgtgtccgtcgtacgcctaacgcgtttccg

SEQ ID NO: 410769 - DNA, 592 bp, Homo sapiens
  misc_feature: GZ8MTXP01EUCM2.51.61.F06.1.454.CMB.2.raw
  modified_base (254)..(254): a, c, t, g, unknown or other
  modified_base (272)..(272): a, c, t, g, unknown or other
  modified_base (285)..(285): a, c, t, g, unknown or other
  modified_base (339)..(339): a, c, t, g, unknown or other
tcagcgatcgtatacacgaccggtgctcgatttagctacgctctaagggaaaggggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagctatttcttagctggtancagacaaaacagggaacncccctaagctccngatctatgctgctatccctatttgacaaactggactccatcaagtcagcggaangtgatgagggactagtaatcactctacaacatcagcacggcctaggccagaccgtaagtaaacgttattttacggactttaaacgtttattaacctgtaaacaactagtaaaccttttaatacctttacgtaccgttacgggtaacgtttccgggaaccgaaacggggttaaccgtaaaggggtaacggttaaaaccttacgaaaacggtcgttaggtcgggtcttaccggacctaaacccgtttgttaaccg

SEQ ID NO: 410770 - DNA, 538 bp, Homo sapiens
  misc_feature: GZ8MTXP01B9FCI.51.61.F06.1.454.CMB.2.raw
  modified_base (276)..(276): a, c, t, g, unknown or other
  modified_base (289)..(289): a, c, t, g, unknown or other
  modified_base (414)..(414): a, c, t, g, unknown or other
  modified_base (466)..(466): a, c, t, g, unknown or other
  modified_base (526)..(526): a, c, t, g, unknown or other
  modified_base (534)..(534): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagctatttcttagcctggtatcaagacaaaaaccagggaaacncccctaaagctcngatctatgctgctatcccatttcgactaaacgtgacgtcccatcaaggttcaggcgaacagtggatcgtagggacagtaatcactctcaacgaatcaagcaacgcctagcaagcctaggtaaatnttttgacttaaacttattacgtatacaacgattaccttaagtacttactccncgggtaacgttcgaccgaaagggacctaaagggtgaaacttcaaacgaattgaagtccanacctaacngttc

SEQ ID NO: 410771 - DNA, 650 bp, Homo sapiens
  misc_feature: GZ8MTXP01BRF4L.51.61.F06.1.454.CMB.2.raw
  modified_base (279)..(279): a, c, t, g, unknown or other
tcagcgatcgtatacacgaccggtgctcgatttagctacgctctaagggaaagggggagtcagtcccagtcaggacacagcatggacatgagggtccccgctcaactcctggggctcctgctgctctggctcccaggtgccagatgtgacatccagttcgacccagtcctccatcccttctgtctgcatctgtaggagacagagtcaccatcacttgccggcagtcagggctattagctatttcttagcctggtatcaagaacaaaaccgagggaaacnccctaagcctcctgatctatgctgactacttccactttgactaaacgtcggactaccctataccgtaacggttcgacggcggcgtaaaggttgggtaacgtcggtaggggaactacgtaacttcactactacaactaactcaagtccaagtcctcgacgtacgtaccttaagtaagtttatttttaccggaactttaaacttttacttaccgtataaccctaagtacttaacttttaaactacctttaacgtcccgtttaacgggccgtttaacggggaaacccgttaaaggggaaccttaaaggggtaaacgtaaaccttaacgaaacgttacgtggtacggcttaccgcttacttaacttcggttaacc

SEQ ID NO: 410772 - DNA, 554 bp, Homo sapiens
  misc_feature: GZ8MTXP01ALK7J.51.61.F06.1.454.CMB.2.raw
  modified_base (277)..(277): a, c, t, g, unknown or other
  modified_base (405)..(405): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcacatcacttgccgggccagtcagggcattagctatttctttagcctggtatcagacaaaaaccgagggaaacncccctaagcctactgatctatgctgcatccactttgacaaacgtgagtccatcaggttcagcgcagtgatcgtagggacagtaattccatctacacatcagcagcctggcaacggcctagtaaagttntttacggacttaactttactacgtagtacaagtacgttacttaacttaccttacgtaccgtcggtaacgtcggaaaccgtaacgggacgtaaagggtaacgaaacgttaccgttaaacgaacgtgaacgctacgacctaaccgttgtcg

SEQ ID NO: 410773 - DNA, 573 bp, Homo sapiens
  misc_feature: GZ8MTXP01AN3HT.51.61.F06.1.454.CMB.2.raw
  modified_base (372)..(372): a, c, t, g, unknown or other
  modified_base (379)..(379): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagcatttcttagcctggtatcagacaaaaccagggaaacgcccctaagctcctgactctatgctgcactccactttgactaaactggatcccatacaaggttcagcggacaggtgatcgtgggacagaacttcactctnacatcancacgcctgaccgacgaccgttagaaagttacttttacggggacttaacttttaattacctagttaccaacgtagtacctttaaactactttactccgttacgggaacgtttcggaccgtaaacgggaccgtaaagggttaacggaaacttacgaaacgtaaacgtggtaacggactcgactaaccgaacgttcg

SEQ ID NO: 410774 - DNA, 592 bp, Homo sapiens
  misc_feature: GZ8MTXP01EAIEZ.51.61.F06.1.454.CMB.2.raw
  modified_base (252)..(252): a, c, t, g, unknown or other
  modified_base (578)..(578): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtagagacagatcacatcacttcgccggcagtcgaggggcattagctatttcttagctggtancaagaacaaaacgaggaacaccctaagctccagatctatcgctgactactccctatttcgactaaacgtcggactcccatacgtaaggttcacggcgacgaggtggtatcgtagggaacagtaacttcacttacactaacaatacgacgactacgtcgtagaccgacgtacctaaggtaaagtttcttttacgggtaaactttaactttacttactagtaaccaagttacttaaactttactacttaccgtccgtcgggtaacgttccggaaacgaacgggttaaccgaaagggttacgaaaacttcgaaacgtcgttgcgtaccncgactaacgttgtc

SEQ ID NO: 410775 - DNA, 613 bp, Homo sapiens
  misc_feature: GZ8MTXP01E4KEB.51.61.F06.1.454.CMB.2.raw
  modified_base (279)..(279): a, c, t, g, unknown or other
  modified_base (383)..(383): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagctatttctttagcctggtatcaagacaaaaaaccgagggaaacnccccctaaagcctcctgatctatgctgcattcccatttgcaaacgtggactcccatccaaaggttcagcgacagtggatcgagggacagaattcactctacaanaatcaagcacggccctggaccagcccgtagaaagtactttttggaaccttaaactttacttaactgttaaccaaacctagttaccttaaatacctttactccccggtacggtaaccggtttccggaaccggaaacggggaacccgtaaaggggttaacggaaaaacgttaaccaaaaaccgggaacttaggttaacggggccttacggaccctaaccgttaacgtttccg

SEQ ID NO: 410776 - DNA, 542 bp, Homo sapiens
  misc_feature: GZ8MTXP01A0PWE.51.61.F06.1.454.CMB.2.raw
  modified_base (101)..(101): a, c, t, g, unknown or other
  modified_base (289)..(289): a, c, t, g, unknown or other
  modified_base (328)..(328): a, c, t, g, unknown or other
  modified_base (379)..(379): a, c, t, g, unknown or other
  modified_base (384)..(384): a, c, t, g, unknown or other
  modified_base (394)..(394): a, c, t, g, unknown or other
  modified_base (398)..(398): a, c, t, g, unknown or other
  modified_base (523)..(523): a, c, t, g, unknown or other
tcagcgatcgtatacacgaccggtgctcgatttagctacgctctaagggaaagggggagtcagtcccagtcaggacacagcatggacatgagggtccccgntcagctcctggggctcctgctgctctggctcccaggtgccagatgtgacatccagttgacccagtctcatccttcctgtctgcatcgtgtaggagacagagtcacatcacttgccggcagtcaggctatgctatttcttagctagtatacagacaaaacgaggaaacgcccctaagctctgactctangctgctagtcctagtttcgactaaagtggtactcctaancgtaaggtccgagcggtaacagtggatcgtagggactagtactcactctanactancagcagcctnacancgtaagatttacgtgaactatttataccgataccataatactttaatctacgtccgtcggtaacctcggacggtaaaggacgtaaaggtacggttaaattacccgaaaagttcgcgtcggttacncgacctaaccgttgtaacg

SEQ ID NO: 410777 - DNA, 828 bp, Homo sapiens
  misc_feature: GZ8MTXP01EYSL9.51.61.F06.1.454.CMB.2.raw
  modified_base (265)..(265): a, c, t, g, unknown or other
  modified_base (294)..(294): a, c, t, g, unknown or other
tcagcgatcgtatacacgaccggtgctcgatttagctacgctctaaggggaaaggggggagtcagtcccagtcaggacacagcatggacatgagggtccccgctcagctcctggggctcctgctgctctggctcccaggtgccagatgtgacatccagttcgacccagtctccatccttcctgtctgcatctgtaggagacagatcaccatcacgttcggccggcaggtcgagggctagttagcttattttcttagcctaggtanacgaagaaccaaaaaccgacgggaaaccncccctaagtcctacctagtacttctagtcgtctgtacctacttccctaacgtttacgactaaacgtggtacctacctacgtacggtaaggtcgacggacggaacgtaggtcggtaacgtcggtacgggaactaacgtaacttctacctacctacaactaacacgacggacctaacggtcccttaggacccgttaacggtaccgttaaggttaaaaccgtttacgttttttaacggggaaaccctttttaaacggttttaactttaacccgttaaccggttaaacctaaaaccggtttaacgtttaaaccctttttaaaaccgttaacccgtttttaaacccggtccccgggggtttaaacccgggtttaacccgggggtttaacccggggaaacccggggtaaaaaccggggttaaaccccgggtaaaaggggttaaaaccggggttaaaaccctttaaaaccggaaaaaccgggttcgggttaggtaaccggtaccggtaccttaaacccggtaacctttaacgggtttcccg

SEQ ID NO: 410778 - DNA, 517 bp, Homo sapiens
  misc_feature: GZ8MTXP01A9I54.51.61.F06.1.454.CMB.2.raw
  modified_base (250)..(250): a, c, t, g, unknown or other
  modified_base (269)..(269): a, c, t, g, unknown or other
  modified_base (281)..(281): a, c, t, g, unknown or other
  modified_base (368)..(368): a, c, t, g, unknown or other
  modified_base (370)..(370): a, c, t, g, unknown or other
  modified_base (373)..(373): a, c, t, g, unknown or other
  modified_base (412)..(412): a, c, t, g, unknown or other
  modified_base (484)..(484): a, c, t, g, unknown or other
  modified_base (504)..(504): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagatcacatcacttgccggcagtcagggcattagctatttcttagctggtancaagacaaaacgaggaacncccctaagctcngatctatgctgactactcctactttgactaaacgtggactccatacgaggtcagcgacaggtgatcgagggacagtatcactcacanancancacgtcctgcacgctagtaatctttaggacttaaacttntacgtgtacaatagttaacttatacgttacgtccgtcgggtaacgtcggacgaaacggttacgaaagggtanaacacgaacgtaatgcgacngactaacttgtcg

SEQ ID NO: 410779 - DNA, 854 bp, Homo sapiens
  misc_feature: GZ8MTXP01EX4S0.51.61.F06.1.454.CMB.2.raw
  modified_base (179)..(179): a, c, t, g, unknown or other
  modified_base (197)..(197): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttccngtctgcatctagtagganacagagtccacctatcctacgttcggccgggaccagtacggacgggactagtttagcttaagtttttcgttacgccgttggtaactacgaacggaaacccaaaaaaccggaggggaaacccgtaccccccgtaagtccccttaccgtagtacttactagtgtccctagtaccttactaccctttaaccgttttacggaaacccttaaacggtcgggtacccgttaaccccctaaagtttaaccgggttaaacgggttaccacggggccgggtaaacgttaagggggttcgaagtcccggggttaggggaacctaagttaaacccgttccaaactttccttaccaaccaaactaccaacggcaacggccccttaggccccaaaggggccccctttggaaaccggaactttttttaaggggcctaaaccgtttaactttaaaacccctgggtttaccctaaaacccttaacggtaccccttttaaaagttaacccgttttaaattacccctttaccggggtaacccggttttaaccggggttaccccgtaaaacgggggaccccgaaaaaccgggggttttaaaacgttaccgttaaaaccggtaaaccgtacggtaacgggtaaccgtacggttaccgtaacccgttaacgtaacccg

SEQ ID NO: 410780 - DNA, 663 bp, Homo sapiens
  misc_feature: GZ8MTXP01A1MYB.51.61.F06.1.454.CMB.2.raw
  modified_base (267)..(267): a, c, t, g, unknown or other
  modified_base (287)..(287): a, c, t, g, unknown or other
  modified_base (300)..(300): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttcgacccagtcctccatccttcctgtctgcatctggtaggagacagacgtcaccatcacgttcggccggaccaggtcgagggctagttgcttatttcgtgccgtaggtancaagaacaaaacgaggaacnccctaagctctanactctatcgctgactactacctacgttacgactaaacgtcggtacctccaacgtacggtagtcgacggtcgtaacgtaggtcgacgtcggtaagggaactaagttaacttctaaccttacctacaaactacgtaccgaacgtcgtaacccggtctaccggacgtacgtaccgtaagttaacgtttacgtttacggaaactttaacgtttaactaacgtacgtaacaacgttactaacttaacttaccgttctaccggtacggtaaccggtaacgttacggaaacggttccgtaaaaggtaacgaaacgttacgttaaacgtaacggtcgtcgggtacctacgacttaaccgttaactttcccg

SEQ ID NO: 410781 - DNA, 741 bp, Homo sapiens
  misc_feature: GZ8MTXP01CP004.51.61.F06.1.454.CMB.2.raw
  modified_base (265)..(265): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttcgacccagtcctccacttccttcctgtctgcattcgtggtaggagacagagtcacatcacttcgccgggcagtcgagggctattagctatttcttagcctaggtacncaagaaccaaaaacgagggaaacctcccctaaagcctctagactctatcgctagcctactaccttactttcgaactaaacgtgacgtaccctatacgaaaggttcgaacggtcggaacgtaggtcggtagtcggtacggggaactaaggtaacttccaactactacaaactaaacgtcgaacggacctacgtaccctggaccgtaacgtccgttaaaggttaagtttaaccgtttttacggaaaccttttaaacgtttaccttaaccggttaaacgtaaccgaaaactttacggttaaacctttaaacggttacccttacggttaccccggtacggggtaaacccggtttcccgggaaacgggtaaacccggggaaaccgtaaaaggggttacggaaaaaactttcccggaaaaaaccggttaacggtcgggttaacgtaccggtacgttaaccctaaccttaacggttttaaccg

SEQ ID NO: 410782 - DNA, 585 bp, Homo sapiens
  misc_feature: GZ8MTXP02G374I.51.61.F06.1.454.CMB.2.raw
  modified_base (267)..(267): a, c, t, g, unknown or other
  modified_base (275)..(275): a, c, t, g, unknown or other
  modified_base (390)..(390): a, c, t, g, unknown or other
tcagcgatcgtatacacgaccggtgctcgatttagctacgctctaagggaaaggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagctatttcttagcctggtatcagacaaaaaccgngggaaacncccctaagctctgatctatgctgcatccctaactttgacctaaaacgtggactccccataccaaaggttcaggcggacagtggatcgtgggacagaacttcactctacaactaancagacgacgcctcgacgacgacgtagtaagttagtttacgtacttaacttaacttacttacgtactaactaacgtaacttaacttaacttactacgttacggtaccggttaccggtaccggaacggaacggtaaacggtaacggtaaacgtaaacgaaacgtaaacgtacgtacgtacgtacgactactactacg

SEQ ID NO: 410783 - DNA, 513 bp, Homo sapiens
  misc_feature: GZ8MTXP02G08WJ.51.61.F06.1.454.CMB.2.raw
  modified_base (396)..(396): a, c, t, g, unknown or other
tcagcgatcgtatacacgaccggtgctcgatttagctacgctctaagggaaaggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagctatttcttagcctggtatcaagacaaaaaccagggaaacgcccctaagctcctgatctatgctgcatccactttgacaaactggagtccatcaagtcagcgcagtggatcgtagggacagtaattcactctcacaatcagcagcctgcagcctgaaagttntttgactaattatactatacaatatacttaactacttacgtcgtacggtacgtcggacgaacggacgtaaggtacgaaactacgaaaacgaacgtggtcgactagacctactactcg

SEQ ID NO: 410784 - DNA, 554 bp, Homo sapiens
  misc_feature: GZ8MTXP02FURT9.51.61.F06.1.454.CMB.2.raw
  modified_base (276)..(276): a, c, t, g, unknown or other
  modified_base (342)..(342): a, c, t, g, unknown or other
  modified_base (404)..(404): a, c, t, g, unknown or other
  modified_base (421)..(421): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttggccggccagtcagggcattagctatttcttagcctggtatcagacaaaaacgagggaaacncccctaagctctgatctatgctgcactcccactttgacaaactggactcccatcgaaggtcagcgnaggtggatcgtgggacagtaattcactctacaacatcagcacgcctgcagcctagaaagttntttagacttaaactttnttactgtacaacgtatactttaaatacgtttatccgtacggtacgttacggacctaaacggggtaccaaagggtacgaaaactacgaaaaccggtaacgttcggtacggaccttacccaactacgttctttcg

SEQ ID NO: 410785 - DNA, 526 bp, Homo sapiens
  misc_feature: GZ8MTXP02JRGMY.51.61.F06.1.454.CMB.2.raw
  modified_base (391)..(391): a, c, t, g, unknown or other
tcagcgatcgtatacacgaccggtgctcgatttagctacgctctaagggaaaggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggccagtcagggcattagctatttcttagcctggtatcagacaaaaaccaggaaacgcccctaagctcctgatctatgctgcatccatttgcaaactgatccatcaagttcagcgcagtggatcgtagggacagtaattcactctacacaatcagcagcctgcagcctagaagtntttgactaaacttattactagtacaaactagtaccttaaatacttacgtcctcggtacgtttacggacctaaaggggtacccaaagggttcggaaaaatcgaaaacgtaagttgtacggctagcctaaccatccg

SEQ ID NO: 410786 - DNA, 557 bp, Homo sapiens
  misc_feature: GZ8MTXP02JKPL6.51.61.F06.1.454.CMB.2.raw
  modified_base (266)..(266): a, c, t, g, unknown or other
  modified_base (273)..(273): a, c, t, g, unknown or other
  modified_base (364)..(364): a, c, t, g, unknown or other
  modified_base (393)..(393): a, c, t, g, unknown or other
tcagcgatcgtatacacgaccggtgctcgatttagctacgctctaagggaaaggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcatttcttagcctggtatcagacaaaaaccnggaaacncccctaagctcctgatctatgctgcatccactttgacaaactggatccatcaaggtcagcgcagtggatcgtgggacagaacttcactctnacaatcagcagcctgcagcctagaaagtnttttgactaactttattactagtacaaactagtactttaaatactttactcccgtacggtaacgtttccggaccgtaaacggggaacctaaaggggttacggaaaaacttaccgaaaacggtaaacgttggtacgggaccttaggaccaaccctaagtttcccg

SEQ ID NO: 410787 - DNA, 586 bp, Homo sapiens
  misc_feature: GZ8MTXP02IZ8JL.51.61.F06.1.454.CMB.2.raw
  modified_base (273)..(273): a, c, t, g, unknown or other
  modified_base (399)..(399): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcagggcattagctatttcttagcctggtatcagacaaaaacgaggaaacncccctaagctctgatctatgctgcatcctatttgactaaacgtggactcccatcaagttcagcgcagtggatcgtagggacagaattcactctacaacatcagcagccctgcacgctagaaagttnttttacgacttaaactttattacgtatactaaactagttacctttaaattacctttaacgttcccgtacgggtaaccgtttccggaacccgtaaacggggaaaccctaaagggggtacgtaaaaacttaccgaaaaacggtaaccgttaggtacggtacccttacccgaaccctattaccgtttacg

SEQ ID NO: 410788 - DNA, 599 bp, Homo sapiens
  misc_feature: GZ8MTXP02HJAKD.51.61.F06.1.454.CMB.2.raw
  modified_base (250)..(250): a, c, t, g, unknown or other
  modified_base (261)..(261): a, c, t, g, unknown or other
  modified_base (269)..(269): a, c, t, g, unknown or other
  modified_base (275)..(275): a, c, t, g, unknown or other
  modified_base (279)..(279): a, c, t, g, unknown or other
tcagcgatcgtatacacgaccggtgctcgatttagctacgctctaagggaaggggagtcagtcccagtcaggacacagcatggacatgagggtcccgctcagctcctggggctcctgctgctctggctcccaggtgccagatgtgacatccagttgacccagtctccatccttcctgtctgcatctgtaggagacagagtcaccatcacttgccgggcagtcagggcattagcatttcttagcctggtancagcaaaaacngggaaacncccaanctcnatctatgctgcactctacttactacaaactagacgtaccacctacgtaagtacgacgcggacgagtgagtcgtaggacgaagtaatactactactacaacaactacacgacacgaccgtacgacgacgtaccgtacgtaaagttaagtttagtacttaaactttaactttaacttacgtaactaaactaacgtaacttaaacttaacttaactacgttacggtaccggttacggtaccggaaacggaaacggaaacggtaaacggtaaacgtaaacgtaaaacgtaaacgtaacgtacggtacgtacgacgacctactac

SEQ ID NO: 410789 - DNA, 564 bp, Homo sapiens
  misc_feature: GZ8MTXP02GJQ7T.51.61.F06.1.454.CMB.2.raw
  modified_base (394)..(394): a, c, t, g, unknown or other
  modified_base (427)..(427): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagctatttcttagcctggtatcagacaaaaaccaggaaacgcccctaagctcctgatctatgctgcatcctattgacaaatggactccatcaagtcagcgcagtggatcgtagggacagaacttcactctacacatcagcagcctgcagcctagaaagtntttagacttaaactttattacgtgttaccaaanacgtactttaaaactacttaacggtccctacgggtaaccgttaccgggaccgaaaacggggaaccgtaaagggtaggtaaaaactacgaaaaaaccggtaacgtaggttacggactacgaccaacccgtaatttccg

SEQ ID NO: 410790 - DNA, 548 bp, Homo sapiens
  misc_feature: GZ8MTXP02H1RCD.51.61.F06.1.454.CMB.2.raw
  modified_base (273)..(273): a, c, t, g, unknown or other
  modified_base (529)..(529): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagatcaccatcacttggccgggcagtcagggcattagctatttcttagcctgtatcagacaaaaacgaggaaacncccctaagctctgatctatgctgcatcctactttgacaaacgtggactccatcaagtcagcgcaggtgatgtagggacagtaactcaactctacaacaatcagctagtctgacagtcctaagtaagttattttgaaccttaaatttacttactagtacaaactagttactttaaattaccgtttaatcccgttacgggtaccgttacggacgtaaaacgggaccgtaaagggtacgaaaactacaaaacggtaacnggtacgctagacacctatc

SEQ ID NO: 410791 - DNA, 566 bp, Homo sapiens
  misc_feature: GZ8MTXP02FSNYM.51.61.F06.1.454.CMB.2.raw
  modified_base (275)..(275): a, c, t, g, unknown or other
  modified_base (423)..(423): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcatttcttagcctggtatcagacaaaaaccagggaaacncccctaagctcctgatctatgctgcatccactttgacaaactggatccatcaaggttcagcggcagtggatcgtgggacagaattcactctcacatcagcagcctgcagcctgaaagtattttgactaactttattactgtaccaaanagtactttaaatacctttaatcccgttacgggtaccgtttaccgggacccgtaaaacggggaaccctaaaggggttacggaaaaacttccgaaaaacggtaaccgttggttacgggaccttacggaccaacccgtaatttccg

SEQ ID NO: 410792 - DNA, 572 bp, Homo sapiens
  misc_feature: GZ8MTXP02JC23C.51.61.F06.1.454.CMB.2.raw
  modified_base (276)..(276): a, c, t, g, unknown or other
  modified_base (341)..(341): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttggccggcagtcagggcattagctatttcttagcctggtatcaagacaaaaaccgaggaaacncccctaagcctcctgactctatgctgcatcccatttgactaaagtgactccatcgaagtcagcgnagtggatcgtagggacagtattcacttcacacaatcaagcagccctagccacgtacctaggaaactttagttttacgaactttaaactttactttacgtacgttaccaaacgtacgttaactttaaattacctttacgtcccgtacgggtaccgttacggaccgaaacgggtaaccgaaaggtacggaaaactcgaaaacggtaactggtacgcgtagacctacgtattcg

SEQ ID NO: 410793 - DNA, 529 bp, Homo sapiens
  misc_feature: GZ8MTXP02JC195.51.61.F06.1.454.CMB.2.raw
  modified_base (340)..(340): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagctatttcttagcctggtatcagacaaaaaccagggaaacgcccctaagcctcctgatctatgctgcatcccatttgactaaactggatccatcaaggttcagcgnagtggatcgtgggacagaattcactctcaacatcagcagcctgcagctagaagtatttgactaattattactgtacaactatacttaatacttactccgtacggtaccgttacggaccgaaacggggtaccaaagggttacgaaaactacgaaaacggaacgtggtacggactacggactaaccattcg

SEQ ID NO: 410794 - DNA, 560 bp, Homo sapiens
  misc_feature: GZ8MTXP02FU40X.51.61.F06.1.454.CMB.2.raw
  modified_base (263)..(263): a, c, t, g, unknown or other
  modified_base (271)..(271): a, c, t, g, unknown or other
  modified_base (281)..(281): a, c, t, g, unknown or other
  modified_base (365)..(365): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcagggcattagcatttcttagcctggtatcagcaaaaccngggaaacnccctagctcnatctatgctgcactcctattgacaaacgtggactccatcaagtcagcgcagtgatcgaggacagtaacttcactctacactaancagcacgcctgacacgcctagtaaagttatttacgacttaaactttatactagtaaccaagtagtactttaaataccgttactcccgtacggtaccggttaccggaaccgtaaacgggtaaccgtaaagggtaacgtaaaacgtaaccgaaaaccggtaacgttcggtacggtactacgaccaaccgtagttccg

SEQ ID NO: 410795 - DNA, 549 bp, Homo sapiens
  misc_feature: GZ8MTXP02I5AY0.51.61.F06.1.454.CMB.2.raw
  modified_base (276)..(276): a, c, t, g, unknown or other
  modified_base (446)..(446): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagctatttcttagcctggtatcagacaaaaaccagggaaacncccctaagcctcctgatctatgctgcatcccatttgcaaactggatccatcaaggttcagcgcagtggatcgtgggacagaattcactctcaacaatcagcagccctgcagctagaacgtattttgactaatttattactgtacaaactagtactttaaaatcgtttaancccttacgggtaacgtttcggaaccgtaaacgggggaaccaaaggggttcgaaaaacttcgaaaaacgtaacgtcggtaggtacctagaccaacctatttccg

SEQ ID NO: 410796 - DNA, 589 bp, Homo sapiens
  misc_feature: GZ8MTXP02IR1JG.51.61.F06.1.454.CMB.2.raw
  modified_base (196)..(196): a, c, t, g, unknown or other
  modified_base (273)..(273): a, c, t, g, unknown or other
  modified_base (344)..(344): a, c, t, g, unknown or other
  modified_base (367)..(367): a, c, t, g, unknown or other
  modified_base (372)..(372): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccgggccagtcgagggcattagctatttcttagcctgtatcagacaaaacaggaaacnccctaagctctgatctatgctgcactcctactttgactaaacgtggactccatacgagttcagcgcagtgntcgagggacagtaatcactctanactancagcagcctgcacgactagtaagttatttacgacttaactttattaactacgtaacctaactacgttaactttaaaacttacgttaaccgtaccgttaccgggtaaccgtttacgggaaaccgaaacgggggtaaacccgtaaagggttaacgggtaaaaactaaccgtaaaacgtaacgttggggtacgtacggtacacctacccgttaatttccg

SEQ ID NO: 410797 - DNA, 591 bp, Homo sapiens
  misc_feature: GZ8MTXP02JQW7E.51.61.F06.1.454.CMB.2.raw
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcagggcattagctatttcttagcctggtatcagacaaaaaccagggaaacgccccctaaagctcctgatctatgctgcatccactttgacaaactggactcccagtacaaggttcaagcggcaagtggatcgtgggacagaattcactctcaacaaatcaagcaagccctcgacacgacgtacgtaaagtaatttacgtactaacttaattaactacgtactaactaacgtaacttaacttaacttacttaccgttacggtaccggttaccggtaccggtaaacggtaaacggtaaacggtaacggtaaaacgtaaaccgaaaacgtaaacgtaacggtacggtacgtacgtaccgtaacctactacg

SEQ ID NO: 410798 - DNA, 531 bp, Homo sapiens
  misc_feature: GZ8MTXP02JXG93.51.61.F06.1.454.CMB.2.raw
  modified_base (266)..(266): a, c, t, g, unknown or other
  modified_base (272)..(272): a, c, t, g, unknown or other
  modified_base (393)..(393): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagctatttcttagcctggtatcagcaaaaccnggaaancccctaagctctgatctatgctgcatccatttgcaaactggactccatcaaggttcagcggcagtggatcgtgggacagaattcactctcacaatcagcagcctgcagcctagaaacgttntttacgacttaatttattactagtacaactagtactttaactacttacgtccgtacggtaccgttacggacgtaaacgggaacctaacgggtacgaaactaacgaaacgtaacgtcggacggctacgaccacctatcg

SEQ ID NO: 410799 - DNA, 572 bp, Homo sapiens
  misc_feature: GZ8MTXP02I3I3S.51.61.F06.1.454.CMB.2.raw
  modified_base (196)..(196): a, c, t, g, unknown or other
  modified_base (276)..(276): a, c, t, g, unknown or other
  modified_base (397)..(397): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccgggccagtcagggcattagctatttcttagcctggtatcagacaaaaaccgaggaaacncccctaagcctcctgatctatgctgcatcccatttgcaaacgtgactccatcaaggtcagcgcagtgatcgtggacagaacttcactctacacaatcagcagcctgcagcctagaaagttnttttagacttaaactttattacgttagtaccaaagtagtacctttaaaatacctttacgtcccgttacggtaaccgtttccgggaacccgtaaaggggtacccgtaaaggggttacggaaaacttaccgaaaacggtaaacgttggtacggacctacgacctaacctactttccg

SEQ ID NO: 410800 - DNA, 531 bp, Homo sapiens
  misc_feature: GZ8MTXP02FXBZX.51.61.F06.1.454.CMB.2.raw
  modified_base (389)..(389): a, c, t, g, unknown or other
tcagcgatcgtatacacgaccggtgctcgatttagctacgctctaagggaaaggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcagggcattagcatttcttagcctggtatcagacaaaaaccaggaaacgcccctaagctacctgatctatgctgcatccactttgcaaactggatccatcaagtcagcgcagtggatcgtgggacagaattcactctcacaatcgagcagcctgcagcctagaagtnttttagactaaactttattacctagtaccaaactagtactttaaatacgttaatccgtacggtacgttacggacctaaaggggaacccaaggttacggaaaactacaaaaccgtaagtagtaggctcggacaccctattccg

SEQ ID NO: 410801 - DNA, 619 bp, Homo sapiens
  misc_feature: GZ8MTXP02JYL9P.51.61.F06.1.454.CMB.2.raw
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagctatttctttagcctggtatcagacaaaaacgacggaaagacccctaacgactcctgatctatgctgcactcctactttgacaaactggactccactacaaggttcacgtcggacagtggatcgtaggacgagaattcactctacaacaagtcagacacgcctgaccagtacccgtagaaaggtactttttcgactaaacttttaacgttacttacggttaccaaaacctaggttaaccctttaaattaaccgttttaactccccgttacggggtaacccgtttacgggaccccgaaaagggggtaacccgaaagggttaccgggaaaattaaccgaaaacggtaacgttagggtacggtcctacggacacccctaagttccg

SEQ ID NO: 410802 - DNA, 566 bp, Homo sapiens
  misc_feature: GZ8MTXP02J19UN.51.61.F06.1.454.CMB.2.raw
  modified_base (196)..(196): a, c, t, g, unknown or other
  modified_base (276)..(276): a, c, t, g, unknown or other
  modified_base (347)..(347): a, c, t, g, unknown or other
  modified_base (373)..(373): a, c, t, g, unknown or other
  modified_base (379)..(379): a, c, t, g, unknown or other
  modified_base (387)..(387): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccgggcagtcagggcattagctatttcttagcctggtatcaagacaaaaaccagggaaacncccctaagctcctgatctatgctgcactcctactttgactaaacgtggacgtccatacaagtcagcgcagngatcgtggacagtattcactctacanatcaancagtcccngacacgcctagaagttatttacgactaactttatactacgtacaaactactacttaagttacttactccgtacggtaccggttacggaccgaaacggggtaaacctaaaggggtacgtaaaaacgtaccgtaaaacgtaacgtcggttacgggaacctggtaccaaaccgtctttaccg

SEQ ID NO: 410803 - DNA, 541 bp, Homo sapiens
  misc_feature: GZ8MTXP02H1NQS.51.61.F06.1.454.CMB.2.raw
  modified_base (272)..(272): a, c, t, g, unknown or other
  modified_base (339)..(339): a, c, t, g, unknown or other
  modified_base (344)..(344): a, c, t, g, unknown or other
  modified_base (396)..(396): a, c, t, g, unknown or other
tcagcgatcgtatacacgaccggtgctcgatttagctacgctctaagggaaagggggagtcagtcccagtcaggacacatcatggacatgagggtccccgctcagctcctggggctcctgctgctctggctcccaggtgccagatgtgacatccagttgacccagtctccatccttctgtctgcatctgtaggagacagagtcaccatcacttgccgggcagtcagggcatagctatttcttagcctggtatcagacaaaaaccgaggaacncccctaagcctcctgatctacgctgcatcctatttgacaaactggactcccatccaaggttcagcgnagtgntcgtggacagtaacttcactcacacatcagcagctagcaagcctagaaagtntttacgactaactttatactgtacaatagtactttaaatacgttactccgtacgggaacgtttcggaccgtaaagggaacctaaagggtacgaaaactacgaaaacgtacgttaaggacggtactacgactacctagttcctacg

SEQ ID NO: 410804 - DNA, 525 bp, Homo sapiens
  misc_feature: GZ8MTXP02FJOSJ.51.61.F06.1.454.CMB.2.raw
  modified_base (266)..(266): a, c, t, g, unknown or other
  modified_base (274)..(274): a, c, t, g, unknown or other
  modified_base (336)..(336): a, c, t, g, unknown or other
  modified_base (393)..(393): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagcatttcttagcctggtatcagacaaaaaccngggaaacncccctaagctcctgatctatgctgcatcccatttgacaaactggactccatcaagtcagcgnagtgatcgtggacagaattcactctcaacaatcagcagcctagcagcctagaaagtnttttagactaaactttatttactagtacaaactagtactttaaatacttatccctcgggtaccttcggacctaaagggaccaaagggtacgaaaactacgaaaacgaacgtggtcggactgaccaccattcg

SEQ ID NO: 410805 - DNA, 553 bp, Homo sapiens
  misc_feature: GZ8MTXP02ICPTO.51.61.F06.1.454.CMB.2.raw
  modified_base (277)..(277): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagctatttctttagcctggtatcagacaaaaaccagggaaacnccccctaagctcctgatctatgctgcatccactttgacaaactggacgtcccatcaaggttcagcggcagtgatctgggacagattcactctacacaatcagcagcctgcagcctagaagtattttgacttaaactttattactagtacaaactagtacctttaaattacctttatcccgttacgggtaccgtttcggacccgaaagggacccgtaaaggtacgggaaaacttacgaaaacggtaacgttggtacggtctacgccaactacttccg

SEQ ID NO: 410806 - DNA, 518 bp, Homo sapiens
  misc_feature: GZ8MTXP02IVZCD.51.61.F06.1.454.CMB.2.raw
  modified_base (274)..(274): a, c, t, g, unknown or other
  modified_base (375)..(375): a, c, t, g, unknown or other
  modified_base (405)..(405): a, c, t, g, unknown or other
  modified_base (415)..(415): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagcatttcttagcctggtatcagacaaaaaccagggaaacncccctaagctcctgatctatgctgcatcccatttgcaaactggactccatcaagttcagcgcagtggatcgtggggacagaattcaactctacacaatcancagcctgcagctgaatatttgactaatttntactgacaangtacttaaatcttatccgtacggtacgttcggacgaaacgggacgaaggttacgaaaacttcgaaaacggaacttggacggtactacgacctacctatttccg

SEQ ID NO: 410807 - DNA, 609 bp, Homo sapiens
  misc_feature: GZ8MTXP02I3YN2.51.61.F06.1.454.CMB.2.raw
  modified_base (274)..(274): a, c, t, g, unknown or other
  modified_base (369)..(369): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagctatttcttagcctggtatcagacaaaaacaggaaacncccctaagctcctgatcatgctgcatccattgacaaactggactccatcagttcagtcggcagtggatcgtagggacagtatcactcacactaancagcacgcctgacacgtactagtaaagttacttttacgaacctttaaactttagttacgtacgtaacctaaacgtacgttaacctttaaaacttaccgttacgttacccgttacgggtaaccggttacccgggaaaccggtaaacggggtaaaaccgtaaaggggtaaccgtaaaacgtaaccgaaaaccggtaacggttcggtaccggtaccgtacgtacccgtaaccgttacgttccg

SEQ ID NO: 410808 - DNA, 548 bp, Homo sapiens
  misc_feature: GZ8MTXP02HBDF5.51.61.F06.1.454.CMB.2.raw
  modified_base (196)..(196): a, c, t, g, unknown or other
  modified_base (276)..(276): a, c, t, g, unknown or other
  modified_base (403)..(403): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccgggccagtcagggcattagctatttcttagcctggtatcagacaaaaaccgaggaaacncccctaagctcctgatctatgctgcatccctatttgactaaacgtggactccatacaagttcagcgacagtgatcgtggacagtaatcactctacacaatcagcagccctgccagcctagaaagttnttttagacttaaactttattactagtacaaatactacttaaattacttaactccgtacggtaccgttcggaccgaaacgggacctaaagggtacgaaaactccgaaaacgtaacgtggtacggcttacgaccctacgactttccg

SEQ ID NO: 410809 - DNA, 596 bp, Homo sapiens
  misc_feature: GZ8MTXP02HVQV4.51.61.F06.1.454.CMB.2.raw
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttggccgggccagtcagggcattagctatttcttagcctggtatcagacaaaaaccgaggaaacgcccctaaagctcctgatctatgctgcatcctatttgactaaactgggactcccagtacaagggttcaggtcggcaggtggatcgtagggactaagaattcactcctacaccatcagttacgtctacgactaaacgtgtaacgtattttcgaacttaaacctttattaacgtattacaactaagtacggttaaccggtaccctgtcctacgtaccgtttacggggcgggtaaacgggaccgtaaggggtaggtaacgaacgttaccgaaaaacggtaacttggggtacggtactacggaccctaacgtacgttcccttcg

SEQ ID NO: 410810 - DNA, 553 bp, Homo sapiens
  misc_feature: GZ8MTXP02JM14Q.51.61.F06.1.454.CMB.2.raw
  modified_base (280)..(280): a, c, t, g, unknown or other
  modified_base (396)..(396): a, c, t, g, unknown or other
  modified_base (418)..(418): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgcccgggccagtcagggctattagctatttcttagccttggtatcaagacaaaaaccgaggaaacncccctaagcctcctgattctatgctgcactcctatttgactaaacgtggactcccatcaaggtcagcggacaggtggatcgtagggaacagtaacttcactctacaacatcagcancctgacacgacctagaaagttntttacgacttaactttataccgtgtaacaactagtacttaaatacttactccgtacggtacgttccggacgtaaacgggaaccaaggtacgaaaactacgaaaacgtaacgtcgtacggctacgacacctattcg

SEQ ID NO: 410811 - DNA, 546 bp, Homo sapiens
  misc_feature: GZ8MTXP02JZA44.51.61.F06.1.454.CMB.2.raw
  modified_base (282)..(282): a, c, t, g, unknown or other
  modified_base (386)..(386): a, c, t, g, unknown or other
  modified_base (419)..(419): a, c, t, g, unknown or other
tcagcgatcgtatacacgaccggtgctcgatttagctacgctctaagggaaagggggagtcagtcccagtcaggacacagcatggacatggacgggtccccgctcagctccgtggggctcctgctgctctggctcccaggtgccagatgtgacatccagttcgacccagtcctccatccttcctgtctgcatctggtaggagacagagtcaccatcacttggccgggccagtcagggctattagctatttcttagcctggtatcagacaaaacgaggaaacncccctaagcctcctgatctatgctgcatcctatttgactaaactggactcccatacgaaggttcaggcggcaggtgatcgtagggacagacttcactctacaanaatcaagcagccctgctagcttagaaacgtttnttacgacttaacttatactatacaatatacttaactacttactcgtacggtacgtacggacggtacggaacgtacggtaacgaaactaacgaaacgtaagtcggtacgtctacgacctacgtactcg

SEQ ID NO: 410812 - DNA, 603 bp, Homo sapiens
  misc_feature: GZ8MTXP02F7FCU.51.61.F06.1.454.CMB.2.raw
  modified_base (276)..(276): a, c, t, g, unknown or other
  modified_base (337)..(337): a, c, t, g, unknown or other
  modified_base (359)..(359): a, c, t, g, unknown or other
  modified_base (398)..(398): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcagggcattagctatttcttagcctggtatcaagacaaaaaccgagggaaacncccctaagcctcctgatctatgctgcatccatttgacaaactgactccatcaagtcagcgnagtgatgtggacagtatcatcnaacaatcagcacgcctgacctagacctagaaaacgtttntttacgaactttaaactttacttacgtacgtaacctaaatacgttaactttaaacttacctttaacgttcccgttacgggtaaccggtttaccgggaaacccggtaaaacggggtaaaccgaaaggggttaaacgtaaaaaccgttaacccggaaaaacggtaacgttcgggtacggtaccgtacgaaccctaacgtactttccg

SEQ ID NO: 410813 - DNA, 604 bp, Homo sapiens
  misc_feature: GZ8MTXP02IZH0I.51.61.F06.1.454.CMB.2.raw
  modified_base (275)..(275): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgcccgggcagtcgagggcattagctatttcttagcctggtatcagacaaaacgaggaaacncccctaagcctcctgattctatgctgctactccctactttgactaaactggactccatacaaggttcagcggacaggtggatcgtaggacagtaacttcactctacacaactcagcacgcctagccagcctagtaacgttattttgaactttaactttaattactagttaaccaaactagttaactttaaaacttactttaacgtacccgttacggggttaaccgtttacggaaacccggtaaaacgggggaacctaaaacggggtacggtaaaaacttacgaaaaacgtaacgtaggttacggacttagaaccctaccgtaactttcg

SEQ ID NO: 410814 - DNA, 560 bp, Homo sapiens
  misc_feature: GZ8MTXP02HCGZD.51.61.F06.1.454.CMB.2.raw
  modified_base (273)..(273): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagctatttcttagcctggtatcagacaaaacgaggaaacncccctaagcctctgatctatgctgcactccctatttgactaaacgtggacgtccatacaaggttcaggcggacaggtgaatcgtaggggacagtaatcactctacaacaatcagcacgcctgacagtacctagtaagttattttagacttaaactttattactacgtaccaaactagttacttaaacttacttactcccgtacgggtacgttaccgggaacgaacgggaaaccgaagggtacgaaactacgaaaacgaacgtggtacgactacgacctaactattcg

SEQ ID NO: 410815 - DNA, 522 bp, Homo sapiens
  misc_feature: GZ8MTXP02IAI81.51.61.F06.1.454.CMB.2.raw
  modified_base (273)..(273): a, c, t, g, unknown or other
  modified_base (395)..(395): a, c, t, g, unknown or other
tcagcgatcgtatacacgaccggtgctcgatttagctacgctctaagggaaaggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagctatttctttagcctggtatcagacaaaaaccaggaaancccctaagctcctgatctatgctgcatccatttgcaaactggactccatcaaggttcaggcgcagtgatcgtgggacagaattcactctacacaatcaagcagcctgcagcctagaaatttntttacgacttaatttattactatacaaactagtacttaacttacttactccgtacggtacgttacggacgaaacggtacgaaaggtacgaaactaacaaacgaagtgtacgactacgacactactcg

SEQ ID NO: 410816 - DNA, 502 bp, Homo sapiens
  misc_feature: GZ8MTXP02GF2VZ.51.61.F06.1.454.CMB.2.raw
  modified_base (196)..(196): a, c, t, g, unknown or other
  modified_base (364)..(364): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccggcagtcagggcattagctatttcttagcctggtatcagacaaaaaccgaggaaacgcccctaagctcctgatctatgctgcatcctactttgacaaatggactccatcaagtcagcgcagtgatcgtagggacagaattcactctnaacaatcagcagcctgacagcctagaaatatttgacttaacttattactgtaccaaatatacttaaatcttatccgtacgtacgttcggacaacgggaccaaggtacgaaactcaaagaagtcgaggctgacactatc

SEQ ID NO: 410817 - DNA, 630 bp, Homo sapiens
  misc_feature: GZ8MTXP02ITAXF.51.61.F06.1.454.CMB.2.raw
  modified_base (281)..(281): a, c, t, g, unknown or other
  modified_base (395)..(395): a, c, t, g, unknown or other
tcagcgatcgtatacacgaccggtgctcgatttagctacgctctaaggggaaagggggagtcagtcccagtcaggacacagcatggacatgagggtccccgctcagctcctggggctcctgctgctctggctcccaggtgccagatgtgacatccagttgacccagtctccatccttcctgtctgcatctggtaggagacagagtcaccatcacttggccgggccagtcgagggcattagctatttcttagcctggtatcaagacaaaaaccgaggaaacncccctaagcctctgatctatgctgcatcctactttgactaaacgtggactacctatacgtaaggtcacggcggacagggtggatcggtagggactagtaacttcacttctacanaactcagccagccctgacacgtacctaaggtaattacttttcgaactttaaactttattactacgtaacctaaacgtacgttaactttaaaattacctttacgtacccgtacggggttaaccgttaccgggaaaccggtaaacgggtaaaccggtaaacgggtaaggtaaaaaccttaaccgaaaaacggtaacgttcggggtacgaccgtacaacccggtaaactactttaccg

SEQ ID NO: 410818 - DNA, 586 bp, Homo sapiens
  misc_feature: GZ8MTXP02HTFW3.51.61.F06.1.454.CMB.2.raw
  modified_base (271)..(271): a, c, t, g, unknown or other
  modified_base (290)..(290): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagctatttcttagctggtatcagacaaaacaggaaacncccctaagctctgatctangctgcattcctatttcgacaaacgtggactcccatcgaagttcaggcggcagtggatcgtagggactaagaattcactctacaacaatcagcagcctgacagtcctagtaattatttttcgactttaaactttacttacgtagtacctaaactagtactttaaacttaccttactcccgttacgggtacgttaccgggtaccgaaaacggggtaaccgtaaaagggttacgaaaacgttaccgaaaaaacggttaaccgttaggtacggtccgtacgtacccaaccttaacgtttc

SEQ ID NO: 410819 - DNA, 625 bp, Homo sapiens
  misc_feature: GZ8MTXP02HXS64.51.61.F06.1.454.CMB.2.raw
  modified_base (196)..(196): a, c, t, g, unknown or other
  modified_base (288)..(288): a, c, t, g, unknown or other
  modified_base (291)..(291): a, c, t, g, unknown or other
  modified_base (296)..(296): a, c, t, g, unknown or other
  modified_base (406)..(406): a, c, t, g, unknown or other
  modified_base (412)..(412): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccgggccagtcagggcattagctatttcttagcctgtatcaagaaacaaacgaggaaccaccgagctcatatntancgtcngactactaccttagttacaactaagtcgacctaccatacgtacgtacgacggcgacgagggtcgtcttacggacggaactaagttactactaccttaccaacaaactacncgaacncgtacgtccgtagacgtaccgtacgtaaggttaaacgtttcgtttaacgaaaccttttaatttaccgttacgtacgtaaacctaagtactttaaacttaaattaccttacgtaccgtacggtaaccggtaccggaaccggtaaacggaaacgtaagggtaacgaaactaaccgaaagtaacgtcgtacggactacgacctaacgtttcgtacg

SEQ ID NO: 410820 - DNA, 581 bp, Homo sapiens
  misc_feature: GZ8MTXP02HX45D.51.61.F06.1.454.CMB.2.raw
  modified_base (293)..(293): a, c, t, g, unknown or other
  modified_base (363)..(363): a, c, t, g, unknown or other
tcagcgatcgtatacacgaccggtgctcgatttagctacgctctaagggaaaggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagctatttcttagcctggtatcagacaaaaaccaggaaagcccctaagctcctgatcatgntgcatccactttgacaaactggatccatcaaaggttcagcggcagtgatctagggacaagtaattcactntacaacaagtcagcaagcctcgacacgcctagaagtatttagtacttaacctttaattaacttacgttacaaactaacgtaacttaaacttaactttaacttaccgtaccggtaccggttaccggtaccggtaaacggtaaaccggaaacggttaacggaaacgtaaacgaaaacgtaaaccgtacgtaggtacgtacggtacgaacctaacttaccg

SEQ ID NO: 410821 - DNA, 562 bp, Homo sapiens
  misc_feature: GZ8MTXP02JG34D.51.61.F06.1.454.CMB.2.raw
  modified_base (423)..(423): a, c, t, g, unknown or other
  modified_base (444)..(444): a, c, t, g, unknown or other
  modified_base (551)..(551): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcgagggcattagctatttcttagcctggtatcaagacaaaaaccgaggaaacgcccctaagcctcctagatctatgctgcatcctactttgactaaacgtggacgtcccatacgtaaggttcacggcggacaggtggatcgtaggggacagtaacttcactctacactaatcaagcagcctgctagcctaggaaagtnttttacgacttaattattacngtacaaactagtaactttaatacttacgtcccgtacggtaccgttacggaccgtaaaacggggactaaagggtacgaaactacgaaaacgaacgtagtacgccgtanacctactatcg

SEQ ID NO: 410822 - DNA, 602 bp, Homo sapiens
  misc_feature: GZ8MTXP02J09KS.51.61.F06.1.454.CMB.2.raw
  modified_base (266)..(266): a, c, t, g, unknown or other
  modified_base (273)..(273): a, c, t, g, unknown or other
tcagcgatcgtatacacgaccggtgctcgatttagctacgctctaagggaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcgagggcattagctatttcttagcctggtatcagacaaaaccngggaacncccctaagctcctgatctatgctgctactcctactttcgactaaacgtggactccactacgtaaggttcaggcgcaggtggatcgtaggacagtaacttcactctacactaactcaacgcacgcctaggcaacgtcccgtaagaacgtttacttttacggaccttaactttacttaaccgttagttaccaaacgttacgtactttaaactacctttaacgtcccggtacggttaccggttaccggaccgaaacggggtaacccgtaaagggtacgaaaaccttacggaaaaaccgtcgtaacggtcggactacgacctaccgtattccg

SEQ ID NO: 410823 - DNA, 575 bp, Homo sapiens
  misc_feature: GZ8MTXP02FXPAO.51.61.F06.1.454.CMB.2.raw
  modified_base (274)..(274): a, c, t, g, unknown or other
  modified_base (352)..(352): a, c, t, g, unknown or other
  modified_base (383)..(383): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcattgccgggcagtcagggcattagctatttcttagcctggtatcagacaaaaacgagggaaacncccctaagcctacctgatctatgctgcactccctatttgacctaaacgtggaactcccaatcgaaaggttcagcgganagtggatcgtagggacaagtaacttcaactnacaacaatcagcagcctagcagcctagtaaatatttagaacttaactttagttactacgtaaccaaagtattaacttaaattaccgttactcccgtacggtacggttacggaaccgtaaacgggaaccgtaaagggtaccgaaaacttaccggaaaaaacgtcgttaggacgactagaccctaactattccg

SEQ ID NO: 410824 - DNA, 602 bp, Homo sapiens
  misc_feature: GZ8MTXP02GBN48.51.61.F06.1.454.CMB.2.raw
  modified_base (365)..(365): a, c, t, g, unknown or other
  modified_base (368)..(368): a, c, t, g, unknown or other
  modified_base (399)..(399): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagctatttcttagcctggtatcagacaaaaaccgaggaaacgcccctaagctcctgatctatgctgcatcccatttgacaaactggatccatcaaggtcagcgcagtgatcgtagggacagaattcactcncanaatcagcagcctgccagccgtagaaacgttntttagacttaaactttattacctagttaacccaagtacgttacctttaaaatacctttaacgttcccgtacgggttaaccggtttccggaacccgtaaaacgggggtaaacccgtaaaaggggttaacggaaaaacttcccgtaaaaaacggaacgttacggggtcggtaccttacggacccgtaaacccgtaagttttcccg

SEQ ID NO: 410825 - DNA, 523 bp, Homo sapiens
  misc_feature: GZ8MTXP02GC9BA.51.61.F06.1.454.CMB.2.raw
  modified_base (276)..(276): a, c, t, g, unknown or other
  modified_base (342)..(342): a, c, t, g, unknown or other
  modified_base (425)..(425): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagctatttcttagcctggtatcagacaaaaaccagggaaacncccctaagctcctgatctatgctgcatcccactttgacaaactggactcccatcaaggttcagcgnagtggatcgtgggacagaattcactctacacaatcagcagcctgcagcctagaacgtatttgactaacttattactgaccaanagtacttaaatacttactccgtacggacgtttcggaccgaaacgggaccaaagggtcgaaaactcgaaaacgaagtcgtacggctagacacctatacg

SEQ ID NO: 410826 - DNA, 556 bp, Homo sapiens
  misc_feature: GZ8MTXP02FVFDG.51.61.F06.1.454.CMB.2.raw
  modified_base (257)..(257): a, c, t, g, unknown or other
  modified_base (279)..(279): a, c, t, g, unknown or other
  modified_base (426)..(426): a, c, t, g, unknown or other
  modified_base (443)..(443): a, c, t, g, unknown or other
  modified_base (450)..(450): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttggccgggccagtcgagggcattagctatttcttagcctggtancaagaacaaaaacgaggaaacncccctaagcctctgatctatgctgcatccctatttagactaaacgtggactcccaatacgtaaaggtcacggcggactaggtggatcggtagggaacagtaacttcactctacaacgaatcagctacgcctagcagctagtaaattntttcaacttaaactttntaacgtntaaccaatattacttaaagtacttactccgtacggtacgttcgaaccgtaaaggactaaagggtacgaaaactacaaaacgtaagtgtacgctacgacacctattc

SEQ ID NO: 410827 - DNA, 554 bp, Homo sapiens
  misc_feature: GZ8MTXP02F4KRS.51.61.F06.1.454.CMB.2.raw
  modified_base (196)..(196): a, c, t, g, unknown or other
  modified_base (276)..(276): a, c, t, g, unknown or other
  modified_base (379)..(379): a, c, t, g, unknown or other
  modified_base (409)..(409): a, c, t, g, unknown or other
  modified_base (434)..(434): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccggcagtcagggcattagctatttcttagcctggtatcaagacaaaaaccgagggaaacncccctaagcctacctgactctagtgactgctatccctatttcgacaaacgtggactccatcaagtcagcggcagtggatcgtagggacagtaattcactctanacaatcaagcagcctgcagcctagaaagtnttttagaccttaaactttatacgtntaaccacgtatacttaaatcttaactccgtacgggtacgttcgggacctaaagggacctaaaggtaacggaaaactacggaaaacgtaacgttggacgactacgacctaactacgttccg

SEQ ID NO: 410828 - DNA, 514 bp, Homo sapiens
  misc_feature: GZ8MTXP02IQP78.51.61.F06.1.454.CMB.2.raw
  modified_base (196)..(196): a, c, t, g, unknown or other
  modified_base (274)..(274): a, c, t, g, unknown or other
  modified_base (391)..(391): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccgggcagtcagggcattagctatttcttagcctggtatcagacaaaaccagggaaacncccctaagcctcctgatctatgctgcatccatttgacaaactggactccatcaagttcagcgcagtggatcgtagggacagaattcactctcacatcagcagcctgcagctgaaatntttgactaactttatactagtacaacagtacttaaatctttaactcctacggtacgttcggaccgaaacggggaaccaaggtacgaaaactcgaaaagaacgtgacggtactgacaccattcg

SEQ ID NO: 410829 - DNA, 582 bp, Homo sapiens
  misc_feature: GZ8MTXP02GYSBP.51.61.F06.1.454.CMB.2.raw
  modified_base (196)..(196): a, c, t, g, unknown or other
  modified_base (272)..(272): a, c, t, g, unknown or other
  modified_base (337)..(337): a, c, t, g, unknown or other
  modified_base (371)..(371): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccggcagtcagggcattgctatttcttagcctggtatcaagacaaaacgaggaaacncccctaagcctactgatctatgctgacactcctatttgacaaactggactccatcaagtcagcgnagtgatcgaggacagtatcactctacaactaacncagcacgcctgacgtacgactaaggtaattacgtttacaactttaaactttacttacgtacgtaacaaagtacttaactttaaacttaccttacgtaccggtacggtaccggttaccggaacggtaaacgggaacgtaaagggtaacgaaaactaaccggaaaacgtaacgtacggtaccgtaccctaacctaccgttacgttacgttacg

SEQ ID NO: 410830 - DNA, 647 bp, Homo sapiens
  misc_feature: GZ8MTXP02JA1MC.51.61.F06.1.454.CMB.2.raw
  modified_base (280)..(280): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagctatttctttagccttaggtatacagacaaaaaccgaggaaacncccctaagctcctgatctatgctgctactcccactttgaactaaacgtggaacgttccccaagtaccgtaaaggtttccacggcggacgtaggtcgggacttcggtacggggaactacgtaaactttccaacttacctactaaacctaataccgaacggccaacgtccctagacctacggaccgttaggtaaaagttacttttacggaacctttaaacttaactttactaacgttaactaaacgtacgttaactttaaacttactttacgtccgtacgggttacgtaccggacgtaaacggggaaaccaagggttaacgaaaacgtaacgaaaacgtaacgtacgtacggctagacctactacgttc

SEQ ID NO: 410831 - DNA, 524 bp, Homo sapiens
  misc_feature: GZ8MTXP02IJANH.51.61.F06.1.454.CMB.2.raw
  modified_base (274)..(274): a, c, t, g, unknown or other
  modified_base (421)..(421): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagctatttcttagcctggtatcagacaaaaacgaggaaacncccctaagctctgatctatgctgcatcctatttgacaaacgtggactccatactaagtcagcgcagtggatcgtagggacagtaacttcactctacaactaatcagcagcctgacagcctagaagtatttcgaacttaattattacngtacaactagtacttaatacttatccgtacggtacgtacggacgaacggaccgtaaggtacgaaactacaaaacgtaacgtggacgctagacctactcgttcg

SEQ ID NO: 410832 - DNA, 558 bp, Homo sapiens
  misc_feature: GZ8MTXP02F4WYL.51.61.F06.1.454.CMB.2.raw
  modified_base (276)..(276): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcgagggcattagctatttcttagcctggtatcagacaaaaacgaggaaacncccctaagctcctgatctatgctgcatcctactttgactaaacgtggactcccatcaagtcagcgacagtgatcgagggacagtaattcactcacaacatcagacacgcctgacagtaccaagtaagttcttacgaaccttaattacttacggtataacctaaagtacttaacttaaacttacttacgtcgtaccggtacgtaccggaggtaaacggaaccgtaaaggggaactaaaacgacgaaaacggtaactaggtcgacgtacacctacgtactttcg

SEQ ID NO: 410833 - DNA, 560 bp, Homo sapiens
  misc_feature: GZ8MTXP02FVNE2.51.61.F06.1.454.CMB.2.raw
  modified_base (281)..(281): a, c, t, g, unknown or other
  modified_base (414)..(414): a, c, t, g, unknown or other
  modified_base (436)..(436): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttggccgggccagtcgagggctattagctattttcttagcctggtatcagacaaaaaccgagggaaacncccctaagcctctgatctatgctgctatccctattgacaaacgtggactccatacgaggtcaggcgcaggtggactcgtagggacagtaactttcacttctacaacatcagcagcctgacacgctagtaattntttagacttaatttattacgtntaacaagtatactttaatacttactccgtacggtaccgttacggaacgaaacgggtacgtaaaggtacgtaaaactaccgaaaacggtaacgtggtacggtacctaggacccacgttacgtccg

SEQ ID NO: 410834 - DNA, 567 bp, Homo sapiens
  misc_feature: GZ8MTXP02HVP9G.51.61.F06.1.454.CMB.2.raw
  modified_base (168)..(168): a, c, t, g, unknown or other
  modified_base (263)..(263): a, c, t, g, unknown or other
  modified_base (270)..(270): a, c, t, g, unknown or other
  modified_base (289)..(289): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtcnccatccttcctgtctgcatctgtaggagacagagtcaccatcacttgccggcagtcaggcatagctatttcttagcctggtatcagacaaaaccnggaaacncccctaagctctgatctangctgctatcctatttgactaaacgtggacgtcccatcgaagttcaggcggacagtggtatcgtgggactagtaacttcactctacactaatcagcacgcctagcacgctagaagttattttacgactttaaacttattactgttacaaactagttaaccttaattaccttatcccgttacggtaccgtttccggaaccaaacggggtacccaaaagggtacgaaaaactaccgaaaacgtaacgttgggtaacgtctacgacctaaccgttagttccg

SEQ ID NO: 410835 - DNA, 580 bp, Homo sapiens
  misc_feature: GZ8MTXP02INVDD.51.61.F06.1.454.CMB.2.raw
  modified_base (277)..(277): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagctatttcttagcctggtatcaagacaaaaaccgagggaaacncccctaagcctacctgatctatgctgcactccctactttgactaaacgtggacgtccatacgaagttcagcggcagtggatcgtgggactagacttcactctacaactaatcagcagcctaggacacgccgtagtaaagttacttttgaccttaaatttatttaccgtattaccaaactagttaactttaacttacctttacgtccgtacggtaccggttaccggacggtaaacgggaacgtaaagggtacggtaaaactaaccgaaaacgtaacgtggacggtactagacccactacgttcg

SEQ ID NO: 410836 - DNA, 590 bp, Homo sapiens
  misc_feature: GZ8MTXP02G5KY6.51.61.F06.1.454.CMB.2.raw
  modified_base (281)..(281): a, c, t, g, unknown or other
  modified_base (302)..(302): a, c, t, g, unknown or other
  modified_base (317)..(317): a, c, t, g, unknown or other
  modified_base (353)..(353): a, c, t, g, unknown or other
  modified_base (400)..(400): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttcgacccagtctccatccttcctgtctgcatctgtaggagacagagtcacatcacttgccgggcagtcagggctattagctatttcttagcctggtactcaagaccaaaaaccgagggaaaccncccctaagcctcctgatctangctgcatcctatttnactaaacgtgactccatacgaagtcagcgcagtgancgtgggacagtaactcactccgtacaactaactcaacgtcacgtccncgacctacgtacccgtaggtaacgttagttttacgactttaacttacttacgtactacaacgtattacttaacttacgttacgtcgtacggtacgttcgggaaaccgtaaagggacccaaaggggtaaacgtaaacgtaaaccgtaaaacggaagttcggtacgtactacggacctaaccgtctttaccg

SEQ ID NO: 410837 - DNA, 603 bp, Homo sapiens
  misc_feature: GZ8MTXP02IFL5Q.51.61.F06.1.454.CMB.2.raw
  modified_base (195)..(195): a, c, t, g, unknown or other
  modified_base (264)..(264): a, c, t, g, unknown or other
  modified_base (271)..(271): a, c, t, g, unknown or other
  modified_base (411)..(411): a, c, t, g, unknown or other
  modified_base (431)..(431): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttctgtctgcatctgtagganacagagtcaccatcacttgccggcagtcaggcattagctatttcttagcctggtatcagacaaaaacgnggaaacncccctaagctcctgatcatgctgcactctagtttgactaaacgtggactccatacgtaaggtcagcggacagtcggattcgtaggggaccaaggtacttctactacctacaaactaactacgagacctagccctagaccngtaccctagaaaacgttttntttacgaactttaaactttacgttacgtactaacgaaactacgttaactttaaacttacttacgtacccgtacggtaccgttaaccggaaccggaaacggtaaccggtaaaggtaacgtaaaactaacgaaacggtaacgttcggtacggtactacgacctaacgtacgtcg

SEQ ID NO: 410838 - DNA, 557 bp, Homo sapiens
  misc_feature: GZ8MTXP02JP5O6.51.61.F06.1.454.CMB.2.raw
  modified_base (265)..(265): a, c, t, g, unknown or other
  modified_base (272)..(272): a, c, t, g, unknown or other
  modified_base (365)..(365): a, c, t, g, unknown or other
  modified_base (368)..(368): a, c, t, g, unknown or other
  modified_base (527)..(527): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctggtaggagacagagtcacatcacttgccggcagtcagggcattagctatttcttagcctgtatcagacaaaaacgnggaaacncccctaagctctgatctatgctgcatccatttgactaaacgtggactccatcaagttcagcggcagtcggatcgaggacagtaacttcactcncanaatcatcgagccctggacctagacctaggtaaagtattttacgactaaactttattacctagtacaaactgtactttaaataccttacgtccgtacgggttaccgttcgggaaccgaaacggggaacctaaagggttacggaaaacttacgaaaaacgngttagtacggctacgactaccgagtttccg

SEQ ID NO: 410839 - DNA, 563 bp, Homo sapiens
  misc_feature: GZ8MTXP02JRWVR.51.61.F06.1.454.CMB.2.raw
  modified_base (276)..(276): a, c, t, g, unknown or other
  modified_base (407)..(407): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggccagtcagggcattagctatttcttagcctggtatcagacaaaaaccgagggaaacncccctaagcctacctgatctatgactgcatcccactttgacaaactggacgtccatcgaagttcaagtcgcagtggatcgtgggacagtaattcactctacacaatcagcagcctgcagcctagaaagttntttacgacttaatttattactagtactaaactacgttaacttaacttacttactccgttacggtacgttacggaaccgaaacggggtaactaaagggtaacgtaaaactaacggaaaacgtaacgtacggtacggacgtacgacctacctacttcg

SEQ ID NO: 410840 - DNA, 543 bp, Homo sapiens
  misc_feature: GZ8MTXP02JKL55.51.61.F06.1.454.CMB.2.raw
  modified_base (275)..(275): a, c, t, g, unknown or other
  modified_base (411)..(411): a, c, t, g, unknown or other
tcagcgatcgtatacacgaccggtgctcgatttagctacgctctaagggaaagggggagtcattcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagctatttcttagcctggtatcagacaaaaaccagggaaacncccctaagcctcctgatctatgctgcatccctactttgacaaacgtggacgtcccatcaaaggttcaggcggacagtggatcgtgggacagtaacttcactctacaacatcagccagccctagcagcctagaaatntttagactaattattactagacaacagtacttaatacctttatccgtacggtacgttcggaccgaaacgggaccgtaaaggtacgaaaactcaaaacgtaacgtggtacgacgtagacccgacctacgttac

SEQ ID NO: 410841 - DNA, 611 bp, Homo sapiens
  misc_feature: GZ8MTXP02I5HZ2.51.61.F06.1.454.CMB.2.raw
  modified_base (277)..(277): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcacatcacttggccggcagtcagggcattagctatttcttagcctggtatcagaacaaaaaccgagggaaaacnccccctaaagcctcctgattctatcgctagctactccctactttgacaaacgtgacgtcccatacaaggttcacgcggacagtggatcgtagggacagtaacttcactctacaacaactcgacgacacgccctagccacgtaccgtagtaaagttattttaacgacttaaactttaacttactagtaacctaaataacggttacttaaactaacctttacgtacccgtacggtaaccggtttacggaacccggaaacggggtaaaccgaaaaggttacgggaaaaattaccgaaaaacgtaacgtcgtacggacgtacgacctacctacttccg

SEQ ID NO: 410842 - DNA, 563 bp, Homo sapiens
  misc_feature: GZ8MTXP02IQC1N.51.61.F06.1.454.CMB.2.raw
  modified_base (273)..(273): a, c, t, g, unknown or other
  modified_base (427)..(427): a, c, t, g, unknown or other
  modified_base (552)..(552): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatcctcctgtctgcatctgtaggagacagagtcaccatcacttgccgggcagtcagggcattagctatttcttagcctggtatcagacaaaaccgaggaaacncccctaagcctcctgatctatgctgcacttccctactttgacctaaacgtggaacgtccccaataccgaaggttccaggcggactagggtgggatcgtaggggaacagtaacttcactctacaacaatcagcagcctgcagcctagtaaagttnttttagacttaaactttattactacgtacaactagtactttaaatctttaactccgtacggtacgttccggaacgaacgggtaaccaagggtacgaaaactcgaaaagtaacgtggtacgacgtnactacctagtc

SEQ ID NO: 410843 - DNA, 557 bp, Homo sapiens
  misc_feature: GZ8MTXP02G75Y9.51.61.F06.1.454.CMB.2.raw
  modified_base (266)..(266): a, c, t, g, unknown or other
  modified_base (285)..(285): a, c, t, g, unknown or other
  modified_base (356)..(356): a, c, t, g, unknown or other
  modified_base (372)..(372): a, c, t, g, unknown or other
  modified_base (393)..(393): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagctatttcttagcctggtatcagacaaaacgnggaaacgcccctaagctcngatctatgctgcatccatttgacaaatggatccatcaagtcagcggcagtggatcgtagggacagaacttnaactctcaacaatcancagccctgcagcctagaagtntttagactttaacttattactgtaacaacagtactttaaatactttactccgtacgggtacgttccggaacgaaacgggtaaccgaaagggtacggaaaaacttaccgaaaaacggtaacgttcgggtaacggttccgtacggaccctaacctacggtttcccg

SEQ ID NO: 410844 - DNA, 577 bp, Homo sapiens
  misc_feature: GZ8MTXP02FXVXD.51.61.F06.1.454.CMB.2.raw
  modified_base (259)..(259): a, c, t, g, unknown or other
  modified_base (274)..(274): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatggtgacgatccgagttgacccagtctccatcctcctgtctgcatctgtaggagacagagtcaccatcacttgccgggcagtcagggcattagctatttcttagcctggtatcanacaaaaccaggaaancccctaagctcctgatctatgactgcataccctactttgactaaacgtggtaactcccaataccgaaaggttccagcggcaaggttgggaattcgaggggactaggtaaacttcaaacttcacaactaatcagacacgcacgacacgactagtaagtagttacgtactaacttacttacttactaactaactaactacttaacttacttactacgtacggtacgtaccgtacggaacggtaacgtaaacggtaacgtaaacgtaacgaaacgtaacgtacgtacgtacgacgacactactacg

SEQ ID NO: 410845 - DNA, 558 bp, Homo sapiens
  misc_feature: GZ8MTXP02HNEIS.51.61.F06.1.454.CMB.2.raw
  modified_base (268)..(268): a, c, t, g, unknown or other
  modified_base (274)..(274): a, c, t, g, unknown or other
  modified_base (422)..(422): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggccagtcagggcattagctatttcttagcctggtatcagacaaaaaccgnggaacncccctaagctctgatctatgctgcatcctatttgacaaacgtggactccatcgaagttcaggcgcagtgatcgaggacagtatcactctacacaatcagtcagtcctagcagtcctagtaaagtcttttgaactttaattattacgtntacaactagttacctttaaatccttaacgttccgtacggttaccggttcggaaccgaaacggggtaacctaaagggttacggaaacttaaaccgaaaacgtaacgtaggtacgacgtacgacctaacgtactttcg

SEQ ID NO: 410846 - DNA, 679 bp, Homo sapiens
  misc_feature: GZ8MTXP02IUA7Q.51.61.F06.1.454.CMB.2.raw
  modified_base (230)..(230): a, c, t, g, unknown or other
  modified_base (274)..(274): a, c, t, g, unknown or other
  modified_base (286)..(286): a, c, t, g, unknown or other
  modified_base (473)..(473): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagatcaccatcacttgcccgggcagtcagggnattagctatttcttagcctggtatcaagacaaaacgaggaaacnccctaagctctnattctatgctgctactaccctactttgacctaaaacgtcggaacgttccccaattaccgtaaacgggttcaacggtccggactaagggtcggacttcggtaggggaactaagtaatttccgaacttacctacaaactaaactcacgaccagtccccgtgacacgtcctagtaaagttacgtttttanaaccgtttaactttacttaacgttcgtaaactaaaccgtagttacttttaaaacttacgtttaaccttcccgttaccggggttaacgtttacccggggaaacccgttaaacgggggaaaacccttaacgggggtaaacgtaaaaacgttacccgaaaaaaccggtaacgttcggtacgggtactacgaccgtaaacctatttcccg

SEQ ID NO: 410847 - DNA, 557 bp, Homo sapiens
  misc_feature: GZ8MTXP02IRB0F.51.61.F06.1.454.CMB.2.raw
  modified_base (276)..(276): a, c, t, g, unknown or other
  modified_base (557)..(557): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtccaccatcacttgccgggcagtcagggcattagctatttcttagcctggtatcagacaaaaaccagggaaacncccctaagcctcctgatctatgctgcattcccatttgacctaaacgtggaactcccatacgtaaggttcaggcggacagtggatcgagggacagaacttcactctacacatcagcagccctgacagctagaaagttattttacgacttaactttattactacgttaccaaacgtatacttaaaattcttacgtccgtacggtaacgttcggaaccacggggaaaccaaggtacggaaaactcggaaaagcgaaacgttggacggtactcggactaaccgtn

SEQ ID NO: 410848 - DNA, 578 bp, Homo sapiens
  misc_feature: GZ8MTXP02F059A.51.61.F06.1.454.CMB.2.raw
  modified_base (275)..(275): a, c, t, g, unknown or other
  modified_base (369)..(369): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagctatttcttagcctggtatcagacaaaaccgagggaaacncccctaagctacctgatctatgctgcatccatttgacaaacgtgactccatcaagttcagcgcaggtgactcgtagggacagtaattcactcanaacatcagactacgcctggactacgtacctagtaaacgttattttagacttaaactttattacctagtaacaactatacctttaaaatctttaacgtcccgtacggtaccgtttacggaccggtaaacgggtacccgtaaaggtaacggtaaaactccgtaaaaacgtaaccgtagggtcggtactacggacctaaccgtactttaccg

SEQ ID NO: 410849 - DNA, 549 bp, Homo sapiens
  misc_feature: GZ8MTXP02JK25Z.51.61.F06.1.454.CMB.2.raw
  modified_base (196)..(196): a, c, t, g, unknown or other
  modified_base (276)..(276): a, c, t, g, unknown or other
  modified_base (392)..(392): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccgggccagtcagggcattagctatttcttagcctggtatcagacaaaaaccgaggaaacncccctaagctacctgatctatgctgctatcctactttgactaaaacgtggacgtcccagtcaaaggttcaggcgacagtggatgtagggacagtaatcactctcaacatcagcacncctgacagcctagaaattgttttagacttaactttattactgtacaactgtacttaaatacttactcgtacggtaacgttccggaaccgtaaacgggaccaagggttacgaaaactacgaaaacgtcgtaggttcggactcggactaaccatttccg

SEQ ID NO: 410850 - DNA, 560 bp, Homo sapiens
  misc_feature: GZ8MTXP02I13V1.51.61.F06.1.454.CMB.2.raw
  modified_base (196)..(196): a, c, t, g, unknown or other
  modified_base (274)..(274): a, c, t, g, unknown or other
  modified_base (371)..(371): a, c, t, g, unknown or other
  modified_base (386)..(386): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccgggcagtcagggcattagctatttcttagcctggtatcaagacaaaacgaggaaacncccctaagctctgatctatgctgctactcctattgactaaacgtggactccatacgaaggtcaggcgcgagtggatcgaggacagtactcactctanaacatcagcagtccngcagtctagtaagttattttagactttaattactttacgtagtaaccaaagtagttactttaaacttacctttacgtccgtacgggtaccggttacggaccggaaacggggtaaccaaagggttacgaaaactacgaaaacggtaacgttggtacgactcgacctactatttcg

SEQ ID NO: 410851 - DNA, 599 bp, Homo sapiens
  misc_feature: GZ8MTXP02FJ2TD.51.61.F06.1.454.CMB.2.raw
  modified_base (286)..(286): a, c, t, g, unknown or other
  modified_base (419)..(419): a, c, t, g, unknown or other
  modified_base (439)..(439): a, c, t, g, unknown or other
tcagcgatcgtatacacgaccggtgctcgatttagctacgctctaaggggaaagggggagtcagtcccagtcaggacacagcatggacatgagggtccccgctcagctcctggggctcctgctgctctggctcccaggtgccagatgtgacatccagttcgacccagtcctccattcccttcctgtctgcatctgtaggagacagagtcaccatcacttggcccgggccagtcgagggctattagctatttcttagcctggtatcagacaaaaaccgagggaaacncccctaagcctcctgatctatgctgcactccacttgactaaacgtggactccatcgaaggtcaggcgctaggtgatcgaggacagtaactcactctacaacaactcagcacgcctgcacgctagtaaacgttnttttacgacttaaaactttnttaactcgtaaccaaacgtattaacctttaaaagttacctttaacgttcccggttaaccggtaacggtttaccggaaaccggaaacggggtaaaccgtaaagggtaacgtaaaacaccgtaaaacgaaccgttggtaacggctagacctaacgtcttccg

SEQ ID NO: 410852 - DNA, 558 bp, Homo sapiens
  misc_feature: GZ8MTXP02IYGSM.51.61.F06.1.454.CMB.2.raw
  modified_base (267)..(267): a, c, t, g, unknown or other
  modified_base (275)..(275): a, c, t, g, unknown or other
  modified_base (372)..(372): a, c, t, g, unknown or other
  modified_base (403)..(403): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcatttcttagcctggtatcagacaaaaaccngggaaacncccctaagcctcctgatctatgctgcatcccatttgacaaacgtggacgtcccatcaaggttcagcggcagtggatcgtgggacagaattcactctnaacaatcagcagcctgcagcctagaaagttntttagacttaaatttacttactacgtacaactagttaactttaaattacttacgtcccgtacggtaccgttacggaaccgaaacgggaaccgtaaacgggtaacgtaaaactaacgaaaacgtaacgtacggtacgacgtacgacctactacttc

SEQ ID NO: 410853 - DNA, 654 bp, Homo sapiens
  misc_feature: GZ8MTXP02ITCE7.51.61.F06.1.454.CMB.2.raw
  modified_base (279)..(279): a, c, t, g, unknown or other
  modified_base (362)..(362): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctggtaggagacagagtcaccatcacgttggcccgggcagtcgagggcattagctatttcttagcctggtatcagacaaaaccgagggaacncccctaagcctctagattctatgactgactacttccctatttgacctaaacgtcggactcccataccgtaaggttcaggcganaggtggtactacggtggggaactagtaacttccgacttcctacaaactaacgtacacgtcgacgcccgtgaccaggtacctaaggtaaagtttacttttgaaactttaaactttacttaacgtacgtaacaaacgttattaactttaaacttaccgttacgtcccggttaaccgggttacggttaccgggaaccggtaaacggggtaaaccgtaaaggggttaacgaaaacgttaacccggtaaaaggtaacgttacggtacggtacctacggtaaccctacctaatttccg

SEQ ID NO: 410854 - DNA, 621 bp, Homo sapiens
  misc_feature: GZ8MTXP02H2GHW.51.61.F06.1.454.CMB.2.raw
  modified_base (197)..(197): a, c, t, g, unknown or other
  modified_base (274)..(274): a, c, t, g, unknown or other
  modified_base (614)..(614): a, c, t, g, unknown or other
tcagcgatcgtatacacgaccggtgctcgatttagctacgctctaaggggaaagggggagtcagtcccagtcaggacacagcatggacatgagggtccccgctcagctcctggggctcctgctgctctggctcccaggtgccagatgtgacatccagttgacccagtctccatccttctgtctgcatctggtagganacagagtcacatcacttggccgggcagtcgagggctatagctatttcttagctggtatcagacaaaacgaggaaacncccctaagcctctgtactctatgctgacacttcctactttcgactaaaacgtggaacgtacccaataccgtaaggttcacggtcggacgagtggggtaattcggtaggggaactaagtaactcctaactactacaaacaactcaagccagccctaggaccacgtacctaggtaaacgtttacttttgaacctttaaatttacttacttacgtactaaactagttaactttaaatacctttaacgtcccgttacggtaccggttaccggaccggtaaacgggtaaaccgtaaagggtaacgaaacgttaaccgaaaacgtaacgtggtacggctacgaccncgtactc

SEQ ID NO: 410855 - DNA, 579 bp, Homo sapiens
  misc_feature: GZ8MTXP02HDNTQ.51.61.F06.1.454.CMB.2.raw
  modified_base (255)..(255): a, c, t, g, unknown or other
  modified_base (270)..(270): a, c, t, g, unknown or other
  modified_base (434)..(434): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttggccgggccagtcagggcattgctatttcttagctgatcanacaaaacgaggaacnccctaagctctgatctatgctgacactccctactttgacctaaacgtcggacgtccacgtacgaacggttcacggcggactaggtggtatcggtagggactaaggtaactacactacctacaacatacagcccgacgccctagaccacgtacgtagtaaagttnttttacgactttaacttacttactagtacaactagtaacttaactacttacgtaccgttacgggtacgttacggacggaacggtaaccaagggtaacgaaactaacgaaacgtaacgtcgacggtactacgactaccgtattacg

SEQ ID NO: 410856 - DNA, 546 bp, Homo sapiens
  misc_feature: GZ8MTXP02JLENY.51.61.F06.1.454.CMB.2.raw
  modified_base (274)..(274): a, c, t, g, unknown or other
  modified_base (408)..(408): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcagggcattgctatttcttagcctggtatcagacaaaaaccgagggaaacncccctaagcctcctagactctatgctgcatccctatttgactaaactggacgtcccatcgaaggttcagcggcagtggatcgagggacagacttcactctcaacatcgagcacgcctgacagcctagaaacgtnttttgacttaattattactagtacaactagtacttaataccttactccgtacggtaccgttacggaccgtaaacgggaccaaggggttacgaaaacgtacaaaacggtaacgtggtacggctagacctaccgtattcg

SEQ ID NO: 410857 - DNA, 537 bp, Homo sapiens
  misc_feature: GZ8MTXP02HZ77V.51.61.F06.1.454.CMB.2.raw
  modified_base (196)..(196): a, c, t, g, unknown or other
  modified_base (255)..(255): a, c, t, g, unknown or other
  modified_base (272)..(272): a, c, t, g, unknown or other
  modified_base (368)..(368): a, c, t, g, unknown or other
  modified_base (402)..(402): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccgggccagtcagggcattagctatttcttagctggtatnagacaaaacgaggaacncccctaagcctctgatctatgctgcattcctactttgactaaacgtggactccatcaaggttcagcgcagtggatcgtgggacagtaatcactcanacaatcagcagcctgcacgtctagtaaacgtttntttacgacttacttattactatacaatacttacttaaactacttacgtaccgtacggtaccgtacggaaaccgtaacgggacgtaaaggtacgaaaactacgaaaacggtcgtcgacgtcacgacctactactcg

SEQ ID NO: 410858 - DNA, 577 bp, Homo sapiens
  misc_feature: GZ8MTXP02GPU94.51.61.F06.1.454.CMB.2.raw
  modified_base (280)..(280): a, c, t, g, unknown or other
  modified_base (349)..(349): a, c, t, g, unknown or other
  modified_base (368)..(368): a, c, t, g, unknown or other
  modified_base (415)..(415): a, c, t, g, unknown or other
tcagcgatcgtatacacgaccggtgctcgatttagctacgctctaaggggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggccagtcagggcattgctatttcttagcctggtatacaagaacaaaaaccgagggaaaccnccccgtaagcctctagatctatgctgctactcctacttgacaaagtcggactcccagtacgtacggttnacggcgacgtagggtggtntacgtgggactaagtaactttcaacttcactaacatcagcacgtccngacagtactagtattacgttacgactttaaacttattagtaacactaactacttaacttaactaccttacgtccgttacggtacgtaccgggaacgtaacgggtaaacgaaggtaacgaaactaacgaaagtaacgtgtacgtcacgacctacgtactttcg

SEQ ID NO: 410859 - DNA, 574 bp, Homo sapiens
  misc_feature: GZ8MTXP02FNLFT.51.61.F06.1.454.CMB.2.raw
  modified_base (197)..(197): a, c, t, g, unknown or other
  modified_base (279)..(279): a, c, t, g, unknown or other
  modified_base (356)..(356): a, c, t, g, unknown or other
tcagcgatcgtatacacgaccggtgctcgatttagctacgctctaaggggaaagggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccgggccagtcagggcattagctatttctttagcctggtatcagacaaaaaccgagggaaacncccctaagctacctgatctatgctgcatccctactttgacaaactggacgtcccatcgaaggtcagcggcagtggancgtggggacaagaattcactctacacaatcagcagccctgcagacctagaagtattttagactaaactttatttactgtaccaactagtactttaaatacgttaacttcccgtacgggtaccgttacgggaccgaaacggggaaccgaaagggtaacggtaaaactaaccgaaaacggtaaccgtaggtacgggtactacggaccaacctacttaccg

SEQ ID NO: 410860 - DNA, 666 bp, Homo sapiens
  misc_feature: GZ8MTXP02H0J9W.51.61.F06.1.454.CMB.2.raw
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtccacatcacgttggcccggcagtcgagggctattagctatttcttagcgttggtatacaagaacaaaaaccgaggaaaccgcccctaagcctactgactctatcgctgactactaccctatttcgactaacgtcggactccactacgacggttcgacggcggcgaggtggacgtcggtacgggactaacgtactacctacctctaccaaactaaacgtccgaagactaaccgccgtacgacgacggtaccgttaaaggtaagtttactttttaacgacttttaacctttaattacggtaacgttaaccaacgttattaacctttaaactttaccttaccggttccgttaaccgggtaccggttacggaaccggtaaaacgggacgtaaaacggttaacgaaaacgttaacccgaaaagtaaccggttaggacggtacgtacgaccccgtacttaaggtttccg

SEQ ID NO: 410861 - DNA, 519 bp, Homo sapiens
  misc_feature: GZ8MTXP02GK15T.51.61.F06.1.454.CMB.2.raw
  modified_base (196)..(196): a, c, t, g, unknown or other
  modified_base (271)..(271): a, c, t, g, unknown or other
  modified_base (343)..(343): a, c, t, g, unknown or other
  modified_base (369)..(369): a, c, t, g, unknown or other
  modified_base (371)..(371): a, c, t, g, unknown or other
  modified_base (394)..(394): a, c, t, g, unknown or other
  modified_base (398)..(398): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcacatcacttgccggcagtcagggcattagctatttcttagcctggtatcagacaaaacgaggaaacncccctaagctcctgatctatgctgcatcctactttgacaaacgtgacgtccatacgaagtcagtcgcagtgntcgtggacagaatcactctcataacnancacgccagacacgctagtaattnttanaacttacttatacgtacaactaatattacttaacttactacgtcgtacggtaccgtacgaaccgaacggaacgtaaggtacgaaactacgaaacgtaagtcgtacgacacgacactactcg

SEQ ID NO: 410862 - DNA, 791 bp, Homo sapiens
  misc_feature: GZ8MTXP02HK56K.51.61.F06.1.454.CMB.2.raw
  modified_base (314)..(314): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttcgacccagtctccatccttcctgtctgcatcgtggtaggagacaggagtccaaccatcacgttcggcccgggcctaggtccgagggctaagtttacgcctagtttttcttacggccgttaggtaactcaaagaaccgaaaaaaccgagggaaaccnccccgtaagcctctagtattctatcgctgctacgttccctacgtttagactaaacgtcggtactacctaagtccgtaaaggttcaggtcgcgtaaggtcgggtactcggtagggaactaaaggtactacctactacctacaaactactacgacgtacgtaactccgtacgacctacgtaccgtaaggtaaacgtttagtttttaaccgtacctttaaactttaccggtttaaccgttaataaacccgttaaacttaacggtttaacccttttaaaagtttcccgtttacccgttaaccccgggtaacccgggggttttaaccggtttacccgggggaaaaccggttaaaaccgggggaaaccggttaaaaacgggggtaaaccgggtttaaaaaactcccgggggtaaaaaaacgttcggttccggtaccgggttaaccggacttaaacccccggtaacttaaccggtttttacccg

SEQ ID NO: 410863 - DNA, 952 bp, Homo sapiens
  misc_feature: GZ8MTXP02IP8RK.51.61.F06.1.454.CMB.2.raw
tcagcgatcgtatacacgaccggtgctcgatttagctacgctctaaggggaaagggggagtcagtcccagtcaggacacagcatggacatgagggtccccgctcagctcctggggctcctgctgctctggctcccaggtgccagatgtgacatccagttcgacccagtcctccactccttcctgtctgcatcgtgtaggagacagagtccaccatccacgttcggcccggcagtcgagggctagttagcttattttcttacgccgttggtactacgaacgaaaccaaaaaaccggaggggaaaacccgtaccccgtaacgtaccttaccgtagtacgttactacgtcggtacctacgtacctaacctttacccttaacgttttacgaaacccgttaaaaccggttcggtaaccccgttaccctaacgttaccgtaaacgggtttccgaacgggtaccggtacgtaaggttcggggtaacgttcggtaaacgggtaacttaaacttaacttaacctacccttaactacctaaaaccctaactaccggaacggtaacccgtacggttacccggttacggacccggttaaccggtacccgtttaaaaggttaacgggtttttaaaccctttttaccggtaaacccgttttttaaaaccttttaaacgggtttacccttaaacggttaaaaccctaaaacccgtttaaacggtttaacttttaaaaccctttaacccgttttacccgtaacccggggttaacccccggggtttaaaccgggtttaacccccgggggaaaaccggggttaaaacccggggtaaaaacccggtaaaaggggtttaaaaaccggtaaaaacccggttaaacccggtaaaaaaacccgggtcggttttaacgggggaccggtttaccaaccgggtaccccttaaaacgggtttcctttttaaaccccggg

SEQ ID NO: 410864 - DNA, 596 bp, Homo sapiens
  misc_feature: GZ8MTXP02IPW4Y.51.61.F06.1.454.CMB.2.raw
  modified_base (195)..(195): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttctgtctgcatctgtagganacagagtcaccatcacttgccgggcagtcaggcattagctatttcttagcctaggtatcaagacaaaaccgaggaaacgccctaagcctcctagattctatcgctgcacttccctactttgacctaaacgtggactcccagtaccaaggttcaggcggctagtgggtatcggtagggactagtaacttcactctcaacatacagctagccctgcaactctaagtaaagttatttacgaactttaactttacttacgtacttaacaacgtagttactttaaaactccgtttaactccggttacggtaacgttcgggaacgtaaacggggaaaccgtaagggtaacgtaaaacgttacgaaaacgtaacgttggacgtaccgtacgtacctaccgtagtttcc

SEQ ID NO: 410865 - DNA, 601 bp, Homo sapiens
  misc_feature: GZ8MTXP02I8II8.51.61.F06.1.454.CMB.2.raw
  modified_base (273)..(273): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacgttgccggccagtcgaggcattagctatttcttagcctgtatcagacaaaaacgaggaacncccctaagcctctgatctatgctgactactcctatttcgactaaacgtggaactcccaatccgtaaagggttcaaggcgacgaggtcggatcgtagggaacaagtaacttccactctacaaacgtaatcagacacgccctcggacacgtaccttaggtaaagtttactttacgaaaccttaactttacttacgtacgtaacctaacgtaattacctttaaattacctttacgtccgttacggtaccggttcggaaaccggacgggtaaacgaacggtaagtaaaacctacgaaaacgaaccgtggacggtctacgacaaccgttctcg

SEQ ID NO: 410866 - DNA, 690 bp, Homo sapiens
  misc_feature: GZ8MTXP02IBX38.51.61.F06.1.454.CMB.2.raw
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttctgtctgcatctgtaggagacagagtcaccatcacttgccggcagtcgagggctattagcttatttcttagcgtgtatcaagaacaaaaaccgaggaaacacccgtaagcctcctagatctatcgtctgactacttacctacgtttacgacgtaaacgtacgggtacctaccaaccgttaccgtaaacggtttcacgggtcggtaccggtaggttggtaacgttcggtaacggggtaactaggttaaacttccaacttacccaacaactaactacacgaccgactaccgtcgacgacgtaccgtaagtaaaggtttactttttacggaacctttaaacttttacttaccgttaagtaacctaaaacgttagtttaaacctttaaactttaccttaccgttacccgttaccggggttaccggtaccgggtaaccggaaacggttaaccggtaaaggtaaacgtaaacgtaacaaaacggtaacgtcgacggtacgtacaccgtaccttagttccg

SEQ ID NO: 410867 - DNA, 697 bp, Homo sapiens
  misc_feature: GZ8MTXP02JYMO4.51.61.F06.1.454.CMB.2.raw
  modified_base (285)..(285): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttcgacccagtctccatccttcctgtctgcatctgtaggagacagagtcatcatcacgttgcccgggccagtcagggctatagctatttcttagcctggtactcgaagaccaaaaacgaggggaaaccnccccgtaagccttccgtagtactctagtgactcgctacttcccgtactttacgaaccaaaacgtcggtaacctaccccgtatacgtaacggttcgaacggcggcgtaggtggtacgttcggtaggggactaaacgtaaactttccaacctacctacaacttaagaccagaccgacgtcccgagaccgacgtaccgtaggtactttatttacggtaaccttaactttactttaacctgaaccccgttaaatacggttaaacctttaacttaaccgttaaccgtttccccgggtaaccgggggtttacccggttaccggggaaacccccgggttaaaaggggaacccggtaaagggtaaacgtaaaacgtaccgtaaacggtaacgtcggtacggtacctcggaacctactacg

SEQ ID NO: 410868 - DNA, 600 bp, Homo sapiens
  misc_feature: GZ8MTXP02HDR2C.51.61.F06.1.454.CMB.2.raw
  modified_base (196)..(196): a, c, t, g, unknown or other
  modified_base (264)..(264): a, c, t, g, unknown or other
  modified_base (271)..(271): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccggcagtcagggcattagctatttcttagctggtatcagacaaaacgnggaaacnccctaagctctgatctatgctgctatcctatttgactaaagtggacttccaatacgtaaaggttcaggtcggactaggtggacttcgaggggacagtaacttcacttcacactaatcaagctaacgccctggactaacgccgtaagtaaaggttcttttacggaacctttaaacgttacttactacgttaaccaacgtacgtaactttaaactaccttacgtccgtacggtaccgtttacgggacgtaaacgggtaaaccgtaaaggtacgtaaaacgtcgtaaaacggtaacgttaggtcggacgtacgtaacctaccgtatttcccg

SEQ ID NO: 410869 - DNA, 550 bp, Homo sapiens
  misc_feature: GZ8MTXP02G5FQZ.51.61.F06.1.454.CMB.2.raw
  modified_base (277)..(277): a, c, t, g, unknown or other
  modified_base (423)..(423): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttggccgggccagtcagggctattagctatttcttagcctggtatcagacaaaaacgaggaaacncccctaagcctctgacttctatgctgactatcctatttgacaaaacgtgacgtccaagtcaaggtcaggcgagagtcggatcgtagggactagtaacttccactactacaactaagcagtacagcctgacacgcctaagaaagttntttacgaacttaagtttatactgaaacacgtataacttaattacttactccgtacggtacttacggacggggaaactacgaaggtacgaaaactacgaaactaagtggacgtactagaccactagtc

SEQ ID NO: 410870 - DNA, 607 bp, Homo sapiens
  misc_feature: GZ8MTXP02GEPXV.51.61.F06.1.454.CMB.2.raw
  modified_base (198)..(198): a, c, t, g, unknown or other
  modified_base (275)..(275): a, c, t, g, unknown or other
  modified_base (409)..(409): a, c, t, g, unknown or other
tcagcgatcgtatacacgaccggtgctcgatttagctacgctctaaggggaaaggggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttggccggcagtcagggcattagctatttcttagcctgtatcagacaaaaacgaggaaacncccctaagctctgatctatgctgactacttccctactttcgaccaaacgtcggaacgtcccagtaccgtaaggttcgacggtcggactagggtcggactcggtagggacaagtaacttcacttcacaactaacncgacgccacgcctagacgtacgtacgtagtaacgttacttacgtaacttaactttacttacgtacgtaactaacgtacttaactttaactacttacgtccggttacggtaccggtaccggaaccggtaacggaacgtaaggtaacgtaaaacgtaacgaaacgtaacgttcggacgtaccgacgtacctactacttcg

SEQ ID NO: 410871 - DNA, 868 bp, Homo sapiens
  misc_feature: GZ8MTXP02F44Z1.51.61.F06.1.454.CMB.2.raw
  modified_base (286)..(286): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttcgacccagtctccatccttcctgtctgcatctggtaggagacagagtcaccatcacttcggccggcagtcgagggctattacgctattttcttagcctggtatacaagaacaaaaaccgaggaaaccnccccgtaagcctccgtagactctatgctcgctacttaccctactttacgaacctaaacggtcggtaaccgtaccctacgttacggtaaacgggttcgaacgggtccggtacgtaggggttcggtaacgttaccgggttacgggggaaacttaacggttaacctttaccgtaaccctttacccgaaacgtaaaacccgttaaaccgtaccggtaaccggtacccgtacccggtacccggttaccggaacccggttaaccgttacggtttaaaggtttaaacgtttttaccgttttaaccgttaaaccttttaaaacgttttaccgtttaaaccggttaaaccgttaaaccgttaaaccgttttaactttaaaccgtttttaaaacgtttacccgtttaacccgggttacccggggtttaacccggggtttaaaccgggttacccgggtaaaaccggggtaaaaccgggttaaaaccgggtaaaacggggtttaaaaccgtaaaaccggttaaaaccggtaaaacggttaaccgggttacggtacggtacccgttaacggtacccttaacgttaccgtttaccg

SEQ ID NO: 410872 - DNA, 603 bp, Homo sapiens
  misc_feature: GZ8MTXP02FN2SS.51.61.F06.1.454.CMB.2.raw
  modified_base (196)..(196): a, c, t, g, unknown or other
  modified_base (285)..(285): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatcccttctgtctgcatctgtagganacagagtcaccatcacgttcggccgggccaggtcgagggctagttagctattttcttagcctaggtatcaagacaaaaacgaggaaacncccctaagctctagtatctatgctgacatcccatttgactaaagtcggactcccagtacgaaggttcaggtcggactaggtgactcggagggaactagtaacttcactctacaaacatcaagtcacgcctagctacgacctagtaaacttgttacgacttaaactttacttacgtacactaactagttaacttaatacttacgtcgtaccggtacgttaccggaaaccggtaaacggtaaccggaaagggtaacgtaaaaccgtaacgtaaaaccggtaagtaggttacggacctacgtaaccaacgttcgtttaccg

SEQ ID NO: 410873 - DNA, 679 bp, Homo sapiens
  misc_feature: GZ8MTXP02F8RMX.51.61.F06.1.454.CMB.2.raw
  modified_base (277)..(277): a, c, t, g, unknown or other
  modified_base (292)..(292): a, c, t, g, unknown or other
  modified_base (387)..(387): a, c, t, g, unknown or other
tcagcgatcgtatacacgaccggtgctcgatttagctacgctctaaggggaaagggggagtcagtcccagtcaggacacagcatggacatgagggtccccgctcagctcctggggctcctgctgctctggctcccaggtgccagatgtgacatccagttgacccagtctccatccttctgtctgcatctggtaggagacagagtcaccatcacgttgccgggcagtcagggcattagctatttcttagcctggtatcaagacaaaacgagggaaacncccctaagcctctanatctatgctgcatccatttgactaaacgtggactccatacgaagtcagtcggcaggtgactcgtagggaactagtaacttcactcgtacaacaancaagcacgccctagacctacggtacctaggtaaagttacgttttacgaaccgtttaaacttttacgttaaaccgttagtaaacccctaaaagttaacgttaaaccctttttaaaacgttaaccctttaaccgttaccccggttacggggttaaacgtttaccccggggtaaaaccggaaaacggggtaaacccgttaaaacggggtaccggtaaaaaaacttaccggaaaaacccggtaacgttaggggtaaccgggttacctaacggaaccctacccgtagttttaacccg

SEQ ID NO: 410874 - DNA, 625 bp, Homo sapiens
  misc_feature: GZ8MTXP02HOCW6.51.61.F06.1.454.CMB.2.raw
  modified_base (255)..(255): a, c, t, g, unknown or other
  modified_base (266)..(266): a, c, t, g, unknown or other
  modified_base (273)..(273): a, c, t, g, unknown or other
  modified_base (286)..(286): a, c, t, g, unknown or other
  modified_base (300)..(300): a, c, t, g, unknown or other
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcattctgtaggagacagagtcaccatcacttgccgggccagtcagggcattagctattcttagctggtatnagacaaaaacngggaaancccctaagctccngactctatcgcctnactacctactttatacaaactagggacgtacctactcctaaacgggttacgacgacgggtcgaggtaggtacgtcgttagggggaacaacgtaaactttaacaccttactacaaaccggaaataacacgacggacacgtcggtacacgacgtacgtaaggtaagtttacgttagttaactttaaactttaacgttacgtaactaactaactaacttaacttaacttacttacgtacgtacggtacgtacgtacggtaacggaaacggtaaaggtaaacggtaactaaacgaacgtaacgtagacgtacgacgacgactacgttcg

SEQ ID NO: 410875 - DNA, 737 bp, Homo sapiens
  misc_feature: GZ8MTXP02FIGKH.51.61.F06.1.454.CMB.2.raw
tcagcgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttcgacccagtcctccatccttctgtcttcatctgtaggagacagagtccaccatcacttcggccgggcagtcgagggctattagcttatttcttagccttaggtatacgaagaaaccaaaaaccggaagggaaaccacccctaaagtcctaccgtagtacttcgtatcgctacgactaccttaccctactttacgaaccgtaaaccggttcggaacgtcccctaagtacccggtaacggttaccgaggacgggtacagggttaggtacttacgggagggtaaacaagttaaccttacgtaaccttactaacaaactaaactcccgaacggtaccaacgtccccgtaggacctaacgtaccgtaagtaaacgttttatttacgaacctttaactttaattacgttaacgtaactaaacgtacgttaaactttaaacgttaaccgttacctacccgggtacgttaacccgggtaccggtaaaaccgggtaaacgggtaaaaccggtaaagggtaaaacgttaaaaccgaacgtaaaaccgtaaacggtggtaacggcaacgtacctaaagtccgttcttacg

SEQ ID NO: 410876 - DNA, 528 bp, Homo sapiens
  misc_feature: GZ8MTXP01CDA1R.25.85.H08.1.454.CMB.2.raw
  modified_base (252)..(252): a, c, t, g, unknown or other
  modified_base (284)..(284): a, c, t, g, unknown or other
  modified_base (523)..(523): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccgccaggctccgggggaagggactggagtgggtctcagtcatttanaccgatggtcggagatactacacagagtccgngaagggccgattcatcatgtccagagacagttccacgaacacattctttctcatatgaacagcccctgagtgccgaggaacacggccatatattattgtgcgagagtgagtggggctactcttcattctcattactacatggacggtctggggctcgagggaccacggtcaccgtctcctcagcttcaccacgggcccagtccggtcttcccccgttggccgccctgctccaggacgcnctcgg

SEQ ID NO: 410877 - DNA, 605 bp, Homo sapiens
  misc_feature: GZ8MTXP01BT7KH.25.85.H08.1.454.CMB.2.raw
  modified_base (208)..(208): a, c, t, g, unknown or other
  modified_base (252)..(252): a, c, t, g, unknown or other
  modified_base (266)..(266): a, c, t, g, unknown or other
  modified_base (284)..(284): a, c, t, g, unknown or other
  modified_base (344)..(344): a, c, t, g, unknown or other
  modified_base (350)..(350): a, c, t, g, unknown or other
tcagactgtacagtcacgaccggtgctcgatttagtatcactcagtcgcggtgaggacgctgaccacacggaacgtgctgttgtactgcctcctcccgcggctttgtcttggcattatgcacctccacgccgtccacgtaccacttgaactggacctcggggtcttcgtggctcacgtccaccaccacgcacgtgacctcagggtccnccaggctccgggggaaggactgggagtgggtctcagtcatttanaccgatggtcgganatactacacagagtccgngaagggccattcatcatgtccagagacagttcccaagaacactatttctttctcattagngaaacngccctgagtcgaccgagaacctacgcaattatattatgacgagagagtgaggtcgggtcctactccttactacttctactacttactacgtagtacggtacgggtcgtcggggtccgtacggaacggtacccgtaccggtaccgtacccgttcctccctactacgtcctaacccgtaaccgaccggtaccgttaccgtccgtcccgttccccgttccgcccgcccgtccgtccgtccgacgacgtccgccgtccg

SEQ ID NO: 410878 - DNA, 541 bp, Homo sapiens
  misc_feature: GZ8MTXP01CMFQC.25.85.H08.1.454.CMB.2.raw
  modified_base (208)..(208): a, c, t, g, unknown or other
  modified_base (250)..(250): a, c, t, g, unknown or other
  modified_base (282)..(282): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccgggggaaggctggagtgggtctcagtcatttanaccgatggtcggagatactacacagagtccgngaagggccattcatcatgtccagagacagttcccaacgaacacatttctttctcattatgaacagcccctgagtgccgaggaacacgcatatattatgtgcgagagtgagtgggctactcttccattctcattactacatggtacggtctggggctcgagggaccacggtcaccgtctccctcacgctccaccgaagggccccatccgggtccttcccccgttcggccgtcccctgcctccgaggcgccaaccgtcggg

SEQ ID NO: 410879 - DNA, 549 bp, Homo sapiens
  misc_feature: GZ8MTXP01EK4VC.25.85.H08.1.454.CMB.2.raw
  modified_base (251)..(251): a, c, t, g, unknown or other
  modified_base (266)..(266): a, c, t, g, unknown or other
  modified_base (284)..(284): a, c, t, g, unknown or other
  modified_base (325)..(325): a, c, t, g, unknown or other
  modified_base (347)..(347): a, c, t, g, unknown or other
  modified_base (476)..(476): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacttccacgccgtccacgtaccacttgaactggacctcggggtcttcgtggctcacgtccaccaccacgcacgtgacctcaggggtccgccaggctccggggaagggactggagtgggtctcagtcatttanaccgatgggtcgganatactacacagagtccgngaagggccgattcatcatgtccagagacagttccacgaacncatttctttctcatatgaaacngcccctgagtgccgaggaacacggcatatattattgtgcgagagtgaggtggggcctacgtccttcctatttctctattactacagtggacggtcgtggggctcgagggccacggtcaccgtctcctcngcctccaccgacgggcccagtccggtccttccccgttcggccgtccctgccctccaggacgtccgccgtcggg

SEQ ID NO: 410880 - DNA, 538 bp, Homo sapiens
  misc_feature: GZ8MTXP01EW8JY.25.85.H08.1.454.CMB.2.raw
  modified_base (208)..(208): a, c, t, g, unknown or other
  modified_base (251)..(251): a, c, t, g, unknown or other
  modified_base (283)..(283): a, c, t, g, unknown or other
  modified_base (346)..(346): a, c, t, g, unknown or other
  modified_base (526)..(526): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccgggggaaggactggagtgggtctcagtcatttanaccgatggtcggagatactacacagagtccgngaagggccgattcatcatgtccagagacagttccacgaacacatttctttcttcatatgaacngcccctgagtgccgaggaacacggccatatattattgtgcgagagtgagtggggctactccttcattctcattactacatggacgtcgtggggctcgagggccacggtcaccgtctcctcacgcttccacaacgggcccagtccggtcttcccccgttggcccgccctgcctccaggacnccgaaccgtcgg

SEQ ID NO: 410881 - DNA, 571 bp, Homo sapiens
  misc_feature: GZ8MTXP01C18E6.25.85.H08.1.454.CMB.2.raw
  modified_base (208)..(208): a, c, t, g, unknown or other
  modified_base (252)..(252): a, c, t, g, unknown or other
  modified_base (284)..(284): a, c, t, g, unknown or other
  modified_base (480)..(480): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccgggggaaggactgggagtgggtctcagtcatttanaccgatggtcggagatactacacagagtccgngaagggccgattcatcatgtccagagacagttccacgaacactatttcctttctcattatgaaacagcccctgagtgccgaggaacacgcatatattatgtgcgagagtgagtgggcctactccttcctattctactattactacatggacggtcgtggggactcgacggaccgacggtcgtacccgtctccctcncgccttcccgaacgacgggcccacgtccggtccttcccccgttcggttcccgtccccttcgcccgtccgacgggcgccgaacccgtccggg

SEQ ID NO: 410882 - DNA, 536 bp, Homo sapiens
  misc_feature: GZ8MTXP01C4HEI.25.85.H08.1.454.CMB.2.raw
  modified_base (208)..(208): a, c, t, g, unknown or other
  modified_base (252)..(252): a, c, t, g, unknown or other
  modified_base (285)..(285): a, c, t, g, unknown or other
  modified_base (380)..(380): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccgggggaagggactggagtgggtctcagtcatttanaccgatgggtcggagatactacacagagtccgngaaggccatcatcatgccagagacagttccacgaacacatttctttctcatatgaacagcccctgagtgccgagacacgcatatatatgtgcagngtgagtgggctacgtcttcattctcattactacatgacggtcgtggggctcgacggacacggtcaccgtctcctcacgcttccaccgaacgggcccacgttccggtcccttccccgttcggcccgtccctcgcctccaggcgtccaaccgtccggg

SEQ ID NO: 410883 - DNA, 566 bp, Homo sapiens
  misc_feature: GZ8MTXP01BS448.25.85.H08.1.454.CMB.2.raw
  modified_base (252)..(252): a, c, t, g, unknown or other
  modified_base (284)..(284): a, c, t, g, unknown or other
  modified_base (345)..(345): a, c, t, g, unknown or other
  modified_base (389)..(389): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccgccaggctccgggggaagggactggagtgggtctcagtcatttanaccgatggtcggagatactacacagagtccgngaaggccgatcatcatgtccagagacagttccacgaacacatttctttcttcatatgaacngcccctgagtgcccgaggaaccacggcatatattatgtgcgagngtgaggtggggcctactccttcctattctcattactacagtggacggtcgtggggctcgagggcccacggtccaccgtctcctcacgtccttcccaccgacgggtccccagtcccggtccctttcccccgttcggcccgcccctcggccctcccgaggaccgccgttcccgtccggg

SEQ ID NO: 410884 - DNA, 617 bp, Homo sapiens
  misc_feature: GZ8MTXP01EKQ53.25.85.H08.1.454.CMB.2.raw
  modified_base (208)..(208): a, c, t, g, unknown or other
  modified_base (252)..(252): a, c, t, g, unknown or other
  modified_base (266)..(266): a, c, t, g, unknown or other
  modified_base (284)..(284): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccgggggaagggctgggagtgggtctcagtcatttanaccgatggtcgganatactacacagagtccgngaagggccgattcatcatgtccagagacagtccagaacactatttctttctcatactgaaacagcccctgagtgccgaggaacacggccatatattatgtgcgagagtgaggtcgggcctactccttaccattctactattactactaagtcggtacggttcgtgggggtccttacgacgggacccaacggtccgaacccgttctccctcgtacgccttcccgaacccgaaacggggtccccttacgttcccgggttcccttccccccgttcggccccggtccccgttcgcccgttccccgaggggttaccccgtcccgttaacccggtcggg

SEQ ID NO: 410885 - DNA, 547 bp, Homo sapiens
  misc_feature: GZ8MTXP01BR57Q.25.85.H08.1.454.CMB.2.raw
  modified_base (208)..(208): a, c, t, g, unknown or other
  modified_base (252)..(252): a, c, t, g, unknown or other
  modified_base (284)..(284): a, c, t, g, unknown or other
  modified_base (348)..(348): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccgggggaaggactgggagtgggtctcagtcatttanaccgatggtcggagatactacacagagtccgngaagggccattcatcatgtccagagacagttccacgaacactatttctttcttcattatgaacngcccctgagtgcccgaggaaccacggccatatattatgtgcgagagtgagtgggctactcttcattctcattactacatggacggtcgtggggctcgaggaccacggtcaccgtctcctcacgctccaccgaacgggcccagtccggtccttcccccgttcggcccgcccctcgcctcccgaggacgccgccgtccggg

SEQ ID NO: 410886 - DNA, 532 bp, Homo sapiens
  misc_feature: GZ8MTXP01BVQJK.25.85.H08.1.454.CMB.2.raw
  modified_base (208)..(208): a, c, t, g, unknown or other
  modified_base (249)..(249): a, c, t, g, unknown or other
  modified_base (281)..(281): a, c, t, g, unknown or other
  modified_base (344)..(344): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccggggaaggctggagtgggtctcagtcatttanaccgatggtcggagatactacacagagtccgngaagggccgattcatcatgtccagagacagttccacgaacactatttctttctcatatgaacngcccctgagtgccgaggaacacggccatatattatgtgcgagagtgagtgggctactcttcattctcattactacatgacggtctggggctcgaggtccacggtcaccgtctcctcacgccttccacaacgggccccagtccggtccttccccgttggcccgtccctgcctccgagcgccgccgtcgg

SEQ ID NO: 410887 - DNA, 549 bp, Homo sapiens
  misc_feature: GZ8MTXP01D2ELU.25.85.H08.1.454.CMB.2.raw
  modified_base (284)..(284): a, c, t, g, unknown or other
  modified_base (380)..(380): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccgccaggctccggggaagggactgggagtgggtctcagtcatttataccgatggtcggagatactacacagagtccgngaaggccgattcatcatgtccagagacagttccacgaacacatttctttctcatatgaacagcccctgagtgccgaggaacacgcatatattatgngcgagagtgagtgggctactcttcattctcattactacatggacggtctggggctcgaggaccacggtcactgtctcctcacgcttccaccgtaaacgggcccctaagtccggttccttcccccgttcggtcccgtcccctcggcctccacgggtaacgccgtaacccg

SEQ ID NO: 410888 - DNA, 581 bp, Homo sapiens
  misc_feature: GZ8MTXP01BV5NB.25.85.H08.1.454.CMB.2.raw
  modified_base (254)..(254): a, c, t, g, unknown or other
  modified_base (287)..(287): a, c, t, g, unknown or other
  modified_base (328)..(328): a, c, t, g, unknown or other
  modified_base (350)..(350): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcgaggggtccgccaggctccgggggaagggactgggagtgggtctcagtcatttanaccgatggtcggagatactacacaggagtccgngaagggccattcatcatgtccagagacagttcccacgaacnctatttctttctcatatgaacngccctgagtgccgaggacacggcatatattatgtgacgagagtgagtgggcctactcttcattctctattactactatcggacggtcgtggggtctacgaggacccgacggtccaccggtctccctcgacgccttcccaaccgacggccccacgtcccggttcccgttcccccgttcggccccgtccccgttcgcccgttcccgacgggttacgccgttaacccgtccggg

SEQ ID NO: 410889 - DNA, 544 bp, Homo sapiens
  misc_feature: GZ8MTXP01DCV4Z.25.85.H08.1.454.CMB.2.raw
  modified_base (252)..(252): a, c, t, g, unknown or other
  modified_base (284)..(284): a, c, t, g, unknown or other
  modified_base (414)..(414): a, c, t, g, unknown or other
  modified_base (512)..(512): a, c, t, g, unknown or other
  modified_base (531)..(531): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccgccaggctccgggggaagggactggagtgggtctcagtcatttanaccgatggtcggagatactacacagagtccgngaagggccattcatcatgtccagagacagttcccaacgaacactatttccttttctcatatgaacagcccctgagtgccgagaacacgcatatattatgtgcgagagtgagtgggctactcctcattctnattactacatggacgtcgtggggctcgaggaccacggtcaccgtctcctcacgccttccaccgaacgggcccagtccggtccttcccccgttggcccncccgtgcctcccgaggacncgaaccgtccggg

SEQ ID NO: 410890 - DNA, 560 bp, Homo sapiens
  misc_feature: GZ8MTXP01BXNJ1.25.85.H08.1.454.CMB.2.raw
  modified_base (208)..(208): a, c, t, g, unknown or other
  modified_base (250)..(250): a, c, t, g, unknown or other
  modified_base (347)..(347): a, c, t, g, unknown or other
  modified_base (383)..(383): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccggggaaggctgggagtgggtctcagtcatttanaccgatggtcggagatactacacagagtccgagaagggccattcatcatgtccagagacagttcccaacgaacactatttcctttctcatatgaacngcccctgagtgccgaggaacacgcatatatatgtgngagagtgagtgggcctactccttctattctctattactacatggacgtcgtggggctcgaggccacggtcaccgtctcctctacgtccttcccaaccgacgggccccacgtcccgggttcccttcccccgttcggcccgtccctcgccgtccgacggacgccgttaacccgtccggg

SEQ ID NO: 410891 - DNA, 561 bp, Homo sapiens
  misc_feature: GZ8MTXP01EZNTP.25.85.H08.1.454.CMB.2.raw
  modified_base (208)..(208): a, c, t, g, unknown or other
  modified_base (250)..(250): a, c, t, g, unknown or other
  modified_base (264)..(264): a, c, t, g, unknown or other
  modified_base (282)..(282): a, c, t, g, unknown or other
  modified_base (454)..(454): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccgggggaaggctgggagtgggtctcagtcattanaccgatggtcgganatactacacagacgtcgnggaacgggccatcatcatcgccagagacagttccacgaactactatttctttcttacatatgaacagccctggagtgccgaggaacacgcatatattatgtgcgagagtgaggtcgggcctactcttcattctctattactacagtcggacggtcgtggggctcgacggccncggtcaccgtctcctcacgtcctccaccgacgggcccttacgtccggtcccttccccgttcggcccgtcccgtcgtccgtccgacggacgtccgttaaccgtccggg

SEQ ID NO: 410892 - DNA, 576 bp, Homo sapiens
  misc_feature: GZ8MTXP01BP26V.25.85.H08.1.454.CMB.2.raw
  modified_base (210)..(210): a, c, t, g, unknown or other
  modified_base (255)..(255): a, c, t, g, unknown or other
  modified_base (270)..(270): a, c, t, g, unknown or other
  modified_base (292)..(292): a, c, t, g, unknown or other
  modified_base (425)..(425): a, c, t, g, unknown or other
  modified_base (430)..(430): a, c, t, g, unknown or other
  modified_base (497)..(497): a, c, t, g, unknown or other
  modified_base (548)..(548): a, c, t, g, unknown or other
  modified_base (563)..(563): a, c, t, g, unknown or other
  modified_base (565)..(565): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgccacctccacgccgtccacgtaccacttgaactggacctcggggtcttcgtggctcacgtccaccaccacgcacgtgacctcgaggggtccnccaggcgtaccggggaaggactgggagtgggtctcagtcatttanaccgatgggtacganatactacacgaggagtcccggngaacgggcctattccaatccaatcggtaccaagacgaacctagttcccaaacgtaacactattttccctttcttacaagttacagaaactacgccccttggacgtcgaccgagaacacgttcatatattatgngcagngtgagtggcctatccttcattcgtctattacgatagtcggacggtcgtggggctacgacgggaaccncggtccaccgtctccgctagcctccaacgacggcccagtccgtcttcccgngcccgcctgaacccncncgcgcgcgtcg

SEQ ID NO: 410893 - DNA, 752 bp, Homo sapiens
  misc_feature: GZ8MTXP01C77EG.25.85.H08.1.454.CMB.2.raw
  modified_base (208)..(208): a, c, t, g, unknown or other
  modified_base (252)..(252): a, c, t, g, unknown or other
  modified_base (285)..(285): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccagggctccgggggaaggctgggagtgggtctcagtcatttanaccgatgggtcggagatactacacagagtccgngaagggccattcatcatgtccagagacagttccacgtaacactatttcctttctcagttatcggaaacagtcccccttggacgtgacccgagggaaaccacgggtccctaattaactaattttaagttcgggtagaccggtaagggtaggttacggtagggttacgggggtacccttaaccgttcccgtttacctaactttccttacctaactttaacctaaccgtaaagttcggggtaaccggggttccggttacggggggtacccttaccgggtaaccggggaaccccgtacccggggttaccctaaccccggttccttccccgtactaccggtccctttaaccccgaacccgaaacgggggtcccccaacgtttccccgggtccccgtttccccccgttcgggttccccgtccccgtcgtcccgttccccgacgggttaccgtcccgttaacccgttcccgggg

SEQ ID NO: 410894 - DNA, 719 bp, Homo sapiens
  misc_feature: GZ8MTXP01A8JEA.25.85.H08.1.454.CMB.2.raw
  modified_base (209)..(209): a, c, t, g, unknown or other
  modified_base (255)..(255): a, c, t, g, unknown or other
  modified_base (291)..(291): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcgaggggtccnccaggcgtccgggggaagggactgggagtgggtctcagtcatttanaccgatgggtcggagatactacacgagacgtccggnggaacgggccattcatcatcgtccaagcgacagttcccaagaacactatttcctttcttcattatagaacagtcccctggagtcggacccgaggaacccacggcctaattaacttatttacgttggacgacggagtagtaggtaggtcggggacccttaccttcccttacctactttacctactacttaccgtactaagttcgggtaccggggttggttcgggggcttaccggaacgggggacccctaccggggttacctaacccggtccttaccctacgtaccgtccccttcccgaaaccccgttacgggggacccccttacggttccccgggttccccgtttcccccggttcgggccccgttccccgtcccggtcccgttaccccggacggggttacccgccccgttaacccgggtttcccggggg

SEQ ID NO: 410895 - DNA, 569 bp, Homo sapiens
  misc_feature: GZ8MTXP01C8XM6.25.85.H08.1.454.CMB.2.raw
  modified_base (254)..(254): a, c, t, g, unknown or other
  modified_base (287)..(287): a, c, t, g, unknown or other
  modified_base (354)..(354): a, c, t, g, unknown or other
  modified_base (394)..(394): a, c, t, g, unknown or other
  modified_base (400)..(400): a, c, t, g, unknown or other
  modified_base (512)..(512): a, c, t, g, unknown or other
  modified_base (547)..(547): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcgaggggtccgccaggctccgggggaagggactgggagtgggtctcagtcatttanaccgatgggtcggagatactacacagagtccgngaagggccattcatcatgtccagagacagttccaacgaacactatttccttttctcgatatgaaacncgcccctggagtgccgaggaaccacggcatattattatgngcgagngtgaggtgggcctacttcctctacttctctattactacagtcggacggtcgtggggtctcggaggaccgacgtcgaccgtctcctcacgtcctaaccgaccgacgggacccncgtccggtcccttccccgttggccctcccgtaccnccgcgacggcgtccgccgtcgg

SEQ ID NO: 410896 - DNA, 561 bp, Homo sapiens
  misc_feature: GZ8MTXP01A9S6W.25.85.H08.1.454.CMB.2.raw
  modified_base (208)..(208): a, c, t, g, unknown or other
  modified_base (253)..(253): a, c, t, g, unknown or other
  modified_base (285)..(285): a, c, t, g, unknown or other
  modified_base (327)..(327): a, c, t, g, unknown or other
  modified_base (350)..(350): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccgggggaagggactgggagtgggtctcagtcatttanaccgatggtcggagatactacacagagtccgngaagggccattcatcatgtaccagagacagttccaacgaacnctatttctttctcattatgaacngcccctgagtcgccgagaacacggcatatattatgtgcgagagtgaggtcgggcctacgtccttcctattctctattacactagtcggacggtcgtggggctacgacggaccacggtcaccgtctcctcacgtcctccaccgacgggcccagtcccgtcccttccccgttcggcccgtccctgcctccgacggacgccgttaaccgtcggg

SEQ ID NO: 410897 - DNA, 579 bp, Homo sapiens
  misc_feature: GZ8MTXP01A75IY.25.85.H08.1.454.CMB.2.raw
  modified_base (207)..(207): a, c, t, g, unknown or other
  modified_base (249)..(249): a, c, t, g, unknown or other
  modified_base (282)..(282): a, c, t, g, unknown or other
  modified_base (341)..(341): a, c, t, g, unknown or other
  modified_base (348)..(348): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtctcgtggctcacgtccaccaccacgcacgtgacctcaggggtccnccaggctccgggggaaggctggagtgggtctcagtcatttanaccgatgggtcggagatactacacagagtccgngaagggccattcatcatgtccagagacagttccacgaacactatttcctttctcattancgaaacngcccctgagtcgcccgaggaaccacgggccaatagtattattgtagcgtagtagtgaggtcgggccttacttccttacctattctctattactactagtggacggtcgtggggcctacgacggaccgaccggtcaccgtcctcctcacgtcctccgaccacgggccccacgtccgtccttcccccgttcggcccgtccctcgccgtcccgcggacgtccgaaccgtccggg

SEQ ID NO: 410898 - DNA, 671 bp, Homo sapiens
  misc_feature: GZ8MTXP01EE8IS.25.85.H08.1.454.CMB.2.raw
  modified_base (210)..(210): a, c, t, g, unknown or other
  modified_base (258)..(258): a, c, t, g, unknown or other
  modified_base (272)..(272): a, c, t, g, unknown or other
  modified_base (281)..(281): a, c, t, g, unknown or other
  modified_base (366)..(366): a, c, t, g, unknown or other
  modified_base (374)..(374): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcgacggggtccnccgagggccgtaccgggggaagggctgggagtggtctcagtcatttanaccgatgggtcganatactacanagagtcgagaagggcctattcatcatcgtaccaggacgactacgttccaaacgtaacacttattttccttttacttacaatttanacgaaacncgtcccctaggacgtcggaccggaggaaccacggctaaatttattaatttagttggtcgagggtagtaggtgtagggtcgggtccttaccgttccttacctacttactactaattacatagtcggtacggggtcgtcgggggtcctacggacggtacccgacggttacgtacccgttcctcctcgtacgtcccttaaccgaaccgttaccgggcccttacgtcccggttccccttccccggcggttcccgtcccgtcgtccgtccggacggttaccgccgttaacccgggtcggggg

SEQ ID NO: 410899 - DNA, 595 bp, Homo sapiens
  misc_feature: GZ8MTXP01E3E67.25.85.H08.1.454.CMB.2.raw
  modified_base (210)..(210): a, c, t, g, unknown or other
  modified_base (269)..(269): a, c, t, g, unknown or other
  modified_base (406)..(406): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcgacggggtccnccagggcgtccgggggaaggactgggagtgggtctcagtcatttacacgatggtcgganatactacacagagtccgagaaggccgattcatcatgtaccagacgacacgttcccaacgaactactatttctttactcatactgaaacagtcccctaggagtcggaccgaggaaaccacgggctattatattagtgngacgagagtgaggtcgggctactcttacattctctattactacagtcggacggtcgtgggtctcgacggtcccgacggttccacccgtctacccgtcacgtcctcccgaaccgttacgggcccttagtcccggttcccttccccggttgcccgtcccgctccgtccgacggacgtccgaacgtccgggg

SEQ ID NO: 410900 - DNA, 604 bp, Homo sapiens
  misc_feature: GZ8MTXP01BQDQ5.25.85.H08.1.454.CMB.2.raw
  modified_base (257)..(257): a, c, t, g, unknown or other
  modified_base (272)..(272): a, c, t, g, unknown or other
  modified_base (290)..(290): a, c, t, g, unknown or other
  modified_base (358)..(358): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcgaggggtccgccagggccgtccgggggaagggactgggagtgggtctcagtcatttanaccgagtggtcgganatactacacagagtccgngaagggcatcatcatgccagacgacagttccaacgaactactatttcctttcttacatatacgaaacngcccctgagcgaccgaggaaccacggctatattattagtgtgacggtagaggtgaggtcggggtccttacgtccttacctatttctactacttaactacagtacgggtacggttcgggtcgggggccttcgggaacgggacccgtccggtaccgacccgtcctcctcacgtccctaacccgaccgacggcccttacgtccgtcccttcccgttcgccgccctcgccgtcgcgacgtcgccgtcggg

SEQ ID NO: 410901 - DNA, 560 bp, Homo sapiens
  misc_feature: GZ8MTXP01C6BDT.25.85.H08.1.454.CMB.2.raw
  modified_base (208)..(208): a, c, t, g, unknown or other
  modified_base (263)..(263): a, c, t, g, unknown or other
  modified_base (281)..(281): a, c, t, g, unknown or other
  modified_base (386)..(386): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccggggaaggctggagtgggtctcagtcatttataccgatggtcgganatactacacagagtccgngaaggccattcatcatgtccagagacagttccaacgaacactatttccttttctcattactgaaacagcccctgagtgccgaggaaccacggccatatattatgngcgagagtgagtgggcctacgtccttccattctctattacgtactagtcggacgtcgtggggctcgagggcccacggtcaccgtctcctcacgtccttaaccgaccgacgggccccttagtccggtcccttccccgttcggccgtcccctgcctccgagggacctccgccgtcg

SEQ ID NO: 410902 - DNA, 616 bp, Homo sapiens
  misc_feature: GZ8MTXP01AUSUI.25.85.H08.1.454.CMB.2.raw
  modified_base (208)..(208): a, c, t, g, unknown or other
  modified_base (252)..(252): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtgctcacgtccaccaccacgcacgtgacctcgaggggtccncaggcgtccgggggaaggactgggagtgggtctcagtcatttanaccgatgggtcggagatactacacagagtccgagaagggcctatcatcatgtccagagactagttaccacgaacactatttcctttcttacattactgaaactagccccttagagtcgaccgaggtaaccacggcctagtatattagtgtgacgtagagtgaggtcggggaccttactccttacctatttctactaattactactagtcggacggttcgtggggtcctacggacggacccgacggtccgacccgtctccctctacgtccttaacccaaccgacgggtcccacgtcccggttcccttcccccgttcgggcccgtccccgcgtaacctccgacgggaccgcgttaacccgtcgggg

SEQ ID NO: 410903 - DNA, 582 bp, Homo sapiens
  misc_feature: GZ8MTXP01EYII4.25.85.H08.1.454.CMB.2.raw
  modified_base (209)..(209): a, c, t, g, unknown or other
  modified_base (256)..(256): a, c, t, g, unknown or other
  modified_base (270)..(270): a, c, t, g, unknown or other
  modified_base (288)..(288): a, c, t, g, unknown or other
  modified_base (355)..(355): a, c, t, g, unknown or other
  modified_base (548)..(548): a, c, t, g, unknown or other
  modified_base (554)..(554): a, c, t, g, unknown or other
  modified_base (562)..(562): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcgaggggtccnccagggccgtccgggggaaggactgggagtgggtctcagtcatttanaccgatgggtcganatacacacagagtccggngaagggccattcatcatgtccagacgacagttcccacgaacactatttctttactcattatgaaacngcccctggagtgaccgaggaacacggcaatattattatgtgacgtagtagtgaggtacgggtcctacgtcctttacatttctactattacactagtcggtacgggtcgtcggggctcgaacgggcccgtacggtcacccgtctcctcacgtcctccgaacgacgggcccacgtccggtcccttcccgcggccncccgtnccgtccgnggactccgttaaccgtcggg

SEQ ID NO: 410904 - DNA, 693 bp, Homo sapiens
  misc_feature: GZ8MTXP01AFCPR.25.85.H08.1.454.CMB.2.raw
  modified_base (254)..(254): a, c, t, g, unknown or other
  modified_base (269)..(269): a, c, t, g, unknown or other
  modified_base (276)..(276): a, c, t, g, unknown or other
  modified_base (279)..(279): a, c, t, g, unknown or other
  modified_base (357)..(357): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccgccaggccgtccgggggaaggactgggagtgggtctcagtcatttanaccgagtggtcgganatactanacngagtccgaggaggccatcgatcatgaccagacgacagttccaacgaactactatttccgtttctacagttatgaaacngtccgtgagcgccggagaacctacgctaatattagtttgtaggtcgagtaaggtgtaggtacgggtcgggtcccttacccttccgttacctactttccttacttaacttacttaacgtacgttcggtacggggtcggtcggggtaccgtaccggaacggaccccgtaccggtcccgtacccgttcctccccgtactaccgtacccgttaacccgaaccggttaaccggtaccccgttcgtttaccccggttccccgttcccccggttccggttccccgtaaccccgttcgtccccgtaaccggaccgggttaccgtcccgttcccggtaacccggg

SEQ ID NO: 410905 - DNA, 514 bp, Homo sapiens
  misc_feature: GZ8MTXP02G846E.25.85.H08.1.454.CMB.2.raw
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccgccaggctccggggaagggactggagtgggtctcagtcatttataccgatggtcggagatactacacagagtccgtgaagggccgattcatcatgtccagagacagttccacgaacacattctttcttcatatgaacagcccctgagtgccgaggacacggccatatattatgtgcgagagtgagtggggctactccttcattctcattactacatggacgtctggggctcgagggaccacggtcaccgtctcctcagcttccacaaggcccatcggtctcccctgcgcctcgctcagacgcactcg

SEQ ID NO: 410906 - DNA, 563 bp, Homo sapiens
  misc_feature: GZ8MTXP02H2PQN.25.85.H08.1.454.CMB.2.raw
  modified_base (208)..(208): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccgggggaagggactgggagtgggtctcagtcatttataccgatggtcggagatactacacagagtccgtgaagggccgatcatcatgtccagagacagtccagaacacattcttcttcataatgaacagcccctgagtgccgaggacacggccatatattatgtgcgagagtgagtgggcgtactccttctacttctctattactactatgtacgtcgttcgggcgtcgacgggacgaccggtacgtaccgtccgtcctcctacgacttcctacccaacggacccaccgtaccggtccgttccccgttccgccgtcccgtccgccgtccgacgacgaccgaccgtcg

SEQ ID NO: 410907 - DNA, 542 bp, Homo sapiens
  misc_feature: GZ8MTXP02IMEVW.25.85.H08.1.454.CMB.2.raw
tcagactgtacagtcacgaccggtgctcgatttagtatcactcagtcgcggtgaggacgctgaccacacggaacgtgctgttgtactgctcctcccgcggctttgtcttggcattatgcacttccacgccgtccacgtaccacttgaactggacctcggggtcttcgtggctcacgtccaccaccacgcacgtgacctcagggggtccgccagggctccggggaagggactggagtgggtctcagtcatttataccgatggtcggagatactacacagagtccgtgaagggccgattcatcatgtccagagacagttccacgaacacatttctttcttcatatgaaacagcccctgagtgccgaggacacggccatatattattgtgcgagagtgagtggggctactccttcattctcattactacatggacgtcgtgggggctcgagggaccgacggtcaccgtctcctcacgcttccaccaacgggcccagtccggtccttccccctggccgcccgtcgcctccaggacgccaccgtcgg

SEQ ID NO: 410908 - DNA, 543 bp, Homo sapiens
  misc_feature: GZ8MTXP02F9OYD.25.85.H08.1.454.CMB.2.raw
  modified_base (252)..(252): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccgccaggctccgggggaagggactggagtgggtctcagtcatttanaccgatggtcggagatactacacagagtccgtgaagggccgattcatcatgtccagagacagttccacgaacacatttctttcttcatatgaacagcccctgagtgccgaggacacggccatatattatgtgcgagagtgagtggggctacgtccttccattctctattactacatggacgtcgtggggactcgagggaccacggtcaccgtctcctcacgtctccaccaacgggcccatccggtccttcccccgtggcccgcccgtcgcctccgaggacgccaccgtcgg

SEQ ID NO: 410909 - DNA, 533 bp, Homo sapiens
  misc_feature: GZ8MTXP02FY32Z.25.85.H08.1.454.CMB.2.raw
  modified_base (251)..(251): a, c, t, g, unknown or other
  modified_base (346)..(346): a, c, t, g, unknown or other
  modified_base (460)..(460): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccgccaggctccggggaagggactggagtgggtctcagtcatttanaccgatggtcggagatactacacagagtccgtgaagggccgattcatcatgtccagagacagttccacgaacactatttcttctcatatgaaacngcccctgagtgccgagacacggccatatattatgtgcgagagtgagtggggcctactccttcattctcattacactatgacgtcgtggggctcgagggacccaggtcaccgtcncctcacgctccaccaacgggcccactccggtcttcccccgtggccgccctcgcctccgacggacgcactccgg

SEQ ID NO: 410910 - DNA, 536 bp, Homo sapiens
  misc_feature: GZ8MTXP02GCKHI.25.85.H08.1.454.CMB.2.raw
  modified_base (251)..(251): a, c, t, g, unknown or other
  modified_base (344)..(344): a, c, t, g, unknown or other
  modified_base (507)..(507): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccgccaggctccggggaagggactggagtgggtctcagtcatttanaccgatggtcggagatactacacagagtccgtgaagggccgattcatcatgtccagagacagttccacgaacacattctttctcatatgaacngcccctgagtgccgaggacacggccatatattattgtgcgagagtgagtggggcctactccttccattctcattactacatggacgtcgtggggctcgagggaccacggtcaccgtctcctcacgcttccaccagggcccactcggtccttcccccgtggccncccgtcgcctccgaggacgccaccgtcgg

SEQ ID NO: 410911 - DNA, 546 bp, Homo sapiens
  misc_feature: GZ8MTXP02FY34B.25.85.H08.1.454.CMB.2.raw
  modified_base (208)..(208): a, c, t, g, unknown or other
  modified_base (251)..(251): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccggggaagggactggagtgggtctcagtcatttanaccgatggtcggagatactacacagagtccgtgaagggccgattcatcatgtccagagacagttccacgaacacatttctttctcatatgaaacagcccctgagtgccgaggacacggcatatattatgtgcgagagtgagtggggctactcttcattctcattacacatggactcgtgggctcgaggaccacggtcaccgtctccgtcacgccttccaccaaacgggccccaatcccggtcccttcccccgtcggcccgtccccgtcgccctcccgacggacgccaccgtccgg

SEQ ID NO: 410912 - DNA, 544 bp, Homo sapiens
  misc_feature: GZ8MTXP02IDDAO.25.85.H08.1.454.CMB.2.raw
  modified_base (209)..(209): a, c, t, g, unknown or other
  modified_base (347)..(347): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcagggggtccnccaggctccgggggaaggctggagtgggtctcagtcatttataccgatggtcggagatactacacagagtccgtgaagggccgattcatcatgtccagagacagttcccagaacactatttctttcttcatatgaacngcccctgagtgccgaggacacgggccatatattatgtgcgagagtgagtggggcctacgtccttccattctctattactactatggtacgtcgtggggctcgagggaccgacggtcaccgtctcctcacgcttccacctaacgggcccagtccggtccttcccccgtcggccgcccgtcgctccagacgcacctcgg

SEQ ID NO: 410913 - DNA, 515 bp, Homo sapiens
  misc_feature: GZ8MTXP02GM490.25.85.H08.1.454.CMB.2.raw
  modified_base (251)..(251): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccgccaggctccggggaagggactggagtgggtctcagtcatttanaccgatggtcgagatactacacagagtccgtgaagggccgattcatcatgtccagagacagttccacgaacacatttctttctcatatgaacagcccctgagtgccgaggacacggccatatattatgtgcgagagtgagtgggcctactccttcattctcattactacatggacgtcgtggggctcgagggaccacggtcaccgtctcctcagcttccacaaggcccatcggtctcccctgcgcctcgctccagacgcactcg

SEQ ID NO: 410914 - DNA, 546 bp, Homo sapiens
  misc_feature: GZ8MTXP02G0FR1.25.85.H08.1.454.CMB.2.raw
  modified_base (208)..(208): a, c, t, g, unknown or other
  modified_base (345)..(345): a, c, t, g, unknown or other
  modified_base (383)..(383): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccggggaagggactggagtgggtctcagtcatttataccgatggtcggagatactacacagagtccgtgaagggccattcatcatgtccagagacagttccaagaacacatttctttctcatatgaaacngcccctgagtgccgaggaccacggccatatattattgngcgagagtgagtgggcctactccttcattctctattactacatggacgtcgtggggctcgaggaccacggtcaccgtctcctcagccttaccaccgaacgggccccagtccggtcccttcccccgtggcccgcccgtcgcctccgacggacgcctaccgtcgg

SEQ ID NO: 410915 - DNA, 537 bp, Homo sapiens
  misc_feature: GZ8MTXP02GIIB8.25.85.H08.1.454.CMB.2.raw
  modified_base (251)..(251): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccgccaggctccggggaagggactggagtgggtctcagtcatttanaccgatggtcggagatactacacagagtccgtgaagggccgattcatcatgtccagagacagttccacgaacacattctttctcatatgaaacagcccctgagtgccgaggacacggccatatattatgtgcgagagtgagtggggcctactccttccattctcattactacatggacgtcgtggggctcgagggaccacggtcaccgtctcctcacgcttccaccgaaaggcccatccggtccttcccccgtggccgccctcgcctccgacggacgccacctcgg

SEQ ID NO: 410916 - DNA, 540 bp, Homo sapiens
  misc_feature: GZ8MTXP02JC9O9.25.85.H08.1.454.CMB.2.raw
  modified_base (252)..(252): a, c, t, g, unknown or other
  modified_base (368)..(368): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccgccaggctccggggaagggactgggagtgggtctcagtcatttanaccgatggtcggagatactacacagagtccgtgaagggccgattcatcatgtccagagacagttccacgaacacatttctttctcatatgaacagcccctgagtgccgaggacacngccatatattatgtgcgagagtgagtggggcctacgtccttcattctcattactacatggacgtcgtgggctcgagggaccacggtcaccgtctcctcacgtctccaccgaacgggcccacgtccggtccttcccccgtcggccgcccgtcgcctccgacggacgctacccg

SEQ ID NO: 410917 - DNA, 634 bp, Homo sapiens
  misc_feature: GZ8MTXP02IEO33.25.85.H08.1.454.CMB.2.raw
  modified_base (210)..(210): a, c, t, g, unknown or other
  modified_base (258)..(258): a, c, t, g, unknown or other
  modified_base (270)..(270): a, c, t, g, unknown or other
  modified_base (361)..(361): a, c, t, g, unknown or other
  modified_base (381)..(381): a, c, t, g, unknown or other
  modified_base (398)..(398): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtctcgtggctcacgtccaccaccacgcacgtgacctcgacgggggtccnccgagggcgtaccgggggaagggactgggagtgggtctcagtcattanaccgatggcganatactacacagagtccgtaggaagggcctattcatcatcgtccagagacagttaccaacgaactactatttcctttctacagtatgaaacngccctagagtcgcgagaccncgctattatattatggngacgagagtgaggtcgggcctactccttctattctactacttactactagtcggtacgtcggtacggggctacggacgggacccgtaccggtcctaccggttcctccgtacgtaccgtcccgtttacccgaaccggtaaccgggtcccctacggttccccggttcccccgttcccccggtcggtccccgtcccgttacggccgtaccggacggtaccgcccgtaccggtccggggg

SEQ ID NO: 410918 - DNA, 536 bp, Homo sapiens
  misc_feature: GZ8MTXP02JJ946.25.85.H08.1.454.CMB.2.raw
  modified_base (208)..(208): a, c, t, g, unknown or other
  modified_base (252)..(252): a, c, t, g, unknown or other
  modified_base (345)..(345): a, c, t, g, unknown or other
  modified_base (526)..(526): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccggggaagggactgggagtgggtctcagtcatttanaccgatggtcggagatactacacagagtccgtgaagggccgattcatcatgtccagagacagtccacgaacacatttctttctcatatgaacngcccctgagtgccgagacacggccatatattatgtgcgagagtgagtgggctactccttcattctctattactacatggacgtcgtggggctcgacgggaccacggtcaccgtctcctcacgccttccaccgaacgggcccagtccggtccttccccgtcgccgccctcgcctccgaggcnccgacctcgg

SEQ ID NO: 410919 - DNA, 543 bp, Homo sapiens
  misc_feature: GZ8MTXP02FLVOV.25.85.H08.1.454.CMB.2.raw
  modified_base (252)..(252): a, c, t, g, unknown or other
  modified_base (344)..(344): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccgccaggctccgggggaagggactggagtgggtctcagtcatttanaccgatggtcggagatactacacagagtccgtgaagggccgattcatcatgtccagagacagttccacgaacacattcttctcatatgaacngccctgagtgccgaggacacggcatatattatgtgcgagagtgagtggggcctacgtccttcattctctattactacatggacgtcgtggggctcgaggaccacggtccaccgtctcctcacgccttccgaccgaacgggcccacgtccggtccttcccccgtcggccgcccgtcgcctccgacggacgccaccgtcgg

SEQ ID NO: 410920 - DNA, 551 bp, Homo sapiens
  misc_feature: GZ8MTXP02JW217.25.85.H08.1.454.CMB.2.raw
  modified_base (208)..(208): a, c, t, g, unknown or other
  modified_base (252)..(252): a, c, t, g, unknown or other
  modified_base (341)..(341): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccgggggaagggactggagtgggtctcagtcatttanaccgatggtcggagatactacacagagtccgtgaagggccgattcatcatgtccagagacagttccacgaacacattctttctcatatnacagccctgagtgccgagcacggccatatattatgtgcgagagtgagtggggctactcccttcattctctattactacatggtacgtcgtggggctcgacggaccgacggtcaccgtctcctcacgcttccaccgaacgggcccacgtccggtcccttcccccgtcggcccgtccccgtcgcccgtccgacggaccgcctaccgtccggg

SEQ ID NO: 410921 - DNA, 547 bp, Homo sapiens
  misc_feature: GZ8MTXP02GO4NV.25.85.H08.1.454.CMB.2.raw
  modified_base (208)..(208): a, c, t, g, unknown or other
  modified_base (266)..(266): a, c, t, g, unknown or other
  modified_base (383)..(383): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccgggggaagggactggagtgggtctcagtcatttataccgatggtcgganatactacacagagtccgtgaagggccgattcatcatgtccagagacagttccaacgaacactatttctttctcatatgaaacagcccctgagtgccgagacacggcatatattatgngcgagagtgagtgggctactccttcattctctattactacatggacgtcgtgggctcgacggaccacggtcacccgtctcctcgacgctccaccgtaacggccctacgtccggtcccttcccccgtggcccgcccgtcgacctccgacggacgcctaccgtcgg

SEQ ID NO: 410922 - DNA, 542 bp, Homo sapiens
  misc_feature: GZ8MTXP02HMRMK.25.85.H08.1.454.CMB.2.raw
  modified_base (502)..(502): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccgccaggctccggggaagggactggagtgggtctcagtcatttataccgatggtcggagatactacacagagtccgtgaagggccattcatcatgtccagagacagttccaacgacacattctttctcatatgaacagccctgagtgccgagacacggccatatattatgtgcgagagtgagtgggcctactccttcattctctattactacatggtacgtcgtggggctcgagggaccacggtcaccgtctcctcagccttccaccgagggcccctagtccggtccttcccccgnggccgcccccgttagccctccgaggtcgcctacccgtcgg

SEQ ID NO: 410923 - DNA, 538 bp, Homo sapiens
  misc_feature: GZ8MTXP02IVBMF.25.85.H08.1.454.CMB.2.raw
  modified_base (208)..(208): a, c, t, g, unknown or other
  modified_base (251)..(251): a, c, t, g, unknown or other
  modified_base (382)..(382): a, c, t, g, unknown or other
  modified_base (424)..(424): a, c, t, g, unknown or other
  modified_base (477)..(477): a, c, t, g, unknown or other
  modified_base (507)..(507): a, c, t, g, unknown or other
  modified_base (530)..(530): a, c, t, g, unknown or other
  modified_base (533)..(533): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccgggggaaggctgggagtgggtctcagtcatttanaccgatggtcggagatactacacagagtccgtgaagggccgattcatcatgtccagagacagttccacgaacacatttctttctcatatgaacagcccctgagtgccgaggacacggccatatattatgtncgagagtgagtgggacctactccttcacttctctattactanagtggacgtcgttggggctacgacggacccgacggtccaccgtctcctcgacncttccacacggccacgtccgtccttccccnggccgtcctcgcctccacggccnccncgtcg

SEQ ID NO: 410924 - DNA, 543 bp, Homo sapiens
  misc_feature: GZ8MTXP02FYMYM.25.85.H08.1.454.CMB.2.raw
  modified_base (208)..(208): a, c, t, g, unknown or other
  modified_base (250)..(250): a, c, t, g, unknown or other
  modified_base (532)..(532): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccggggaaggactggagtgggtctcagtcatttanaccgatggtcggagatactacacagagtccgtgaagggccgattcatcatgtccagagacagttccacgaacacattcttctcatatgaacagcccctgagtgccgagacacggccatatattatgtgcgagagtgagtgggctacgtccttcattctctattactactatcggacgtcgtggggctcgagggaccacggtcaccgtctcctcagtccttcccaccgaacgggcccacgtccggtccttcccccgtggcccgtcccgtcgccgtccgaggcnccgacctccgg

SEQ ID NO: 410925 - DNA, 545 bp, Homo sapiens
  misc_feature: GZ8MTXP02JXWUO.25.85.H08.1.454.CMB.2.raw
  modified_base (208)..(208): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccggggaagggactggagtgggtctcagtcatttataccgatggtcggagatactacacagagtccgtgaagggccgattcatcatgtccagagacagttccacgaacacatttctttcttcatatgaacagcccctgagtgccgaggacacggccatatattatgtgcgagagtgagtggggcctactccttcattctcattactacatggacgtcgtggggctcgagggaccacggtcaccgtctcctcagcttccaccgaacgggcccacgtccggtccttcccccgtcggcccgcccgtcgcctcccgacggacgccaccgtccgg

SEQ ID NO: 410926 - DNA, 616 bp, Homo sapiens
  misc_feature: GZ8MTXP02IFINN.25.85.H08.1.454.CMB.2.raw
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcgaggggtccgccaggcgtccggggaagggactggagtgggtctcagtcattataccgatggtcgagatactacacagagtccgtaggaagggccgattcatcatgtccagagacagtccacgaacactatttctttctcatatgaacagtcccctagacgtgccgaaggacacggccaattatattagtgtgacgagagtggaggtcggggtccctacgtccctttacctatttctactaacttactaacagttgggtaccgtcgtcggggctacggacgggaccgaccggtaccaccggttcctcccgtcacgtccttcccgaaaccgtacgggacccctacgttcccgggttcccttcccccggtcggccccgtcccgtcgccgtacccgacggtaccgccgtacccgtccgggg

SEQ ID NO: 410927 - DNA, 537 bp, Homo sapiens
  misc_feature: GZ8MTXP02IL6PI.25.85.H08.1.454.CMB.2.raw
  modified_base (208)..(208): a, c, t, g, unknown or other
  modified_base (381)..(381): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccggggaaggactggagtgggtctcagtcatttataccgatggtcgagatactacacagagtccgtagaagggccattcatcatgtccagagacagtccaacgaacacatttctttctcatatgaaacagcccctgagtgccgaggacacggccatatattatgtncgagagtgagtgggcctactcccttcattctcatactacatgacgtctgggctcgaggaccacggtcaccgtctcctcacgcttccaccaacgggcccacgtccgtccttcccccgtggcccgtcccgtcgacctccgacggacgccaccgtccgg

SEQ ID NO: 410928 - DNA, 542 bp, Homo sapiens
  misc_feature: GZ8MTXP02HR0IQ.25.85.H08.1.454.CMB.2.raw
  modified_base (254)..(254): a, c, t, g, unknown or other
  modified_base (388)..(388): a, c, t, g, unknown or other
  modified_base (393)..(393): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcagggggtccgccaggctccgggggaagggactgggagtgggtctcagtcatttanaccgatggtcggagatactacacagagtccgtgaagggccgattcatcatgtccagagacagttccacgaacacatttctttcttcatatgaacagcccctgacgtgccgaggaccacggccatatattattgncgagngtgagtgggcctactccttcattctcattactacattggacgtcgtggggctcgagggaccacggtcaccgtctcctcacgccttccaccgaagggcccagtccggtcctccccgtggccgcccgtcgcctccgacgacgcaccgtcgg

SEQ ID NO: 410929 - DNA, 549 bp, Homo sapiens
  misc_feature: GZ8MTXP02JU5DB.25.85.H08.1.454.CMB.2.raw
  modified_base (208)..(208): a, c, t, g, unknown or other
  modified_base (345)..(345): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccgggggaaggactggagtgggtctcagtcatttataccgatggtcggagatactacacagagtccgtgaagggccgatcatcatgtccagagacagttccacgaacacatttctttcttcatatgaacngcccctgagtgccgaggcacggccatatattatgtgcgagagtgagtggggctacgtcttcattctctattactacatggacgtgtgggctcgaggaccgacggtcaccgtctcctctacgccttccgaccgtaacgggccctactccggtccttcccccgtggcccgtcccgtcgccctccgacggacgccgtaccgtccggg

SEQ ID NO: 410930 - DNA, 551 bp, Homo sapiens
  misc_feature: GZ8MTXP02JFFCO.25.85.H08.1.454.CMB.2.raw
  modified_base (208)..(208): a, c, t, g, unknown or other
  modified_base (253)..(253): a, c, t, g, unknown or other
  modified_base (323)..(323): a, c, t, g, unknown or other
  modified_base (344)..(344): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccgggggaagggactgggagtgggtctcagtcatttanaccgatggtcggagatactacacagagtccgtgaagggccattcatcatgtcagagacagtccacgaacncatttctttctcatatgaacngcccctgagtgccgaggacacggcatatattatgtgcgagagtgagtgggcctacgtccttcattctctattactactatggacgtcgtggggctcgagggaccacggtccaccgtctcctcacgccttaccgaccgaacgggccccacgttccggttcccttcccccgtcggccgtccctcgcctccgacgacgccaccgtccggg

SEQ ID NO: 410931 - DNA, 561 bp, Homo sapiens
  misc_feature: GZ8MTXP02JOIQN.25.85.H08.1.454.CMB.2.raw
  modified_base (208)..(208): a, c, t, g, unknown or other
  modified_base (253)..(253): a, c, t, g, unknown or other
  modified_base (347)..(347): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccgggggaagggactgggagtgggtctcagtcatttanaccgatggtcggagatactacacagagtccgtgaagggccattcatcatgtccagagacagttccacgaacacatttctttcttcatatgaacngcccctgagtgccgaggaccacggccatatattatgtgcgagagtgagtgggctacgtccttcattctctattactactatggacgtcgtggggctcgacgggaccgacggtccaccgtctcctcacgccttccaccgaacgggcccctagtccggtcccttcccccgtcggcccgtccccgtcgtccctccgacggacggcctaccgtccggg

SEQ ID NO: 410932 - DNA, 553 bp, Homo sapiens
  misc_feature: GZ8MTXP02H2XYQ.25.85.H08.1.454.CMB.2.raw
  modified_base (208)..(208): a, c, t, g, unknown or other
  modified_base (370)..(370): a, c, t, g, unknown or other
  modified_base (520)..(520): a, c, t, g, unknown or other
  modified_base (540)..(540): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccgggggaagggactgggagtgggtctcagtcatttataccgatggtcggagatactacacagagtccgtgaaagggccgatcatcatgtccagagacagttcccatgaacactatttctttctcatatgaacacgcctagagtcgccgaggacncggccaatacttattatgtgcgtagagtgaggtgggccctacgtaccttcattctcattactacatcggtacgtcgtggggctgacggtaccacggtcaccgtctccgtcacgtctccaccgaacggcccacgtccggtccctttccccncggccgccccgtgcctccgngacgcctacccgg

SEQ ID NO: 410933 - DNA, 680 bp, Homo sapiens
  misc_feature: GZ8MTXP02IS3RZ.25.85.H08.1.454.CMB.2.raw
  modified_base (208)..(208): a, c, t, g, unknown or other
  modified_base (283)..(283): a, c, t, g, unknown or other
  modified_base (299)..(299): a, c, t, g, unknown or other
  modified_base (302)..(302): a, c, t, g, unknown or other
  modified_base (345)..(345): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccggggaaggactggagtgggtctcagtcatttataccgatggtcggagatactacacagagtccgtnaaagggcgattctacnatntcagagacacgtacacgaacactactttctttcttctatatanaacgacgcccgtcgtagtcgaccggacggaccgaccgccgtacttaattaagtttagttgtagtacggagtaggtacggtagggtacggggtcccgtttacccttaccctttcctacctttacttactaacttaactaacgtacgtacggtaccggttcggttcggggtacgtccgaaccgggacccgtaccggtcctacccgttccgtcccttaccgtacgtacccttacccgaacccgacccgggtacccgttaccgttcccggttccccgttccccccgtcccggcccgtcccgtccgtccgtaaccggacggacgtcccgtacggtccggg

SEQ ID NO: 410934 - DNA, 554 bp, Homo sapiens
  misc_feature: GZ8MTXP02JJDYY.25.85.H08.1.454.CMB.2.raw
  modified_base (251)..(251): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccgccaggctccggggaagggactggagtgggtctcagtcatttanaccgatggtcggagatactacacagagtccgtgaagggccatcatcatgtccagagacagttccacgaacacatttctttctcatatgaacagccctgagtgccgagacacggccatatattatgtgcgagagtgagtgggctactccttcattctctattactacatggacgtcgtggggctcgacggaccacggtcaccgtctccctcacgtccttaccaccgaacgggcccacgtcccgggttcccttccccccgtggccccgccccgttcgccgtccgacggacgccgacccgtccggg

SEQ ID NO: 410935 - DNA, 552 bp, Homo sapiens
  misc_feature: GZ8MTXP02FF5Q0.25.85.H08.1.454.CMB.2.raw
  modified_base (208)..(208): a, c, t, g, unknown or other
  modified_base (252)..(252): a, c, t, g, unknown or other
  modified_base (284)..(284): a, c, t, g, unknown or other
  modified_base (309)..(309): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccgggggaagggactggagtgggtctcagtcatttanaccgatggtcggagatactacacagagtccgngaagggccgattcatcatgtccagngacagttccacgaacacattcttctcatatgaacagccctgagtgccgaggacacggccatatattatgtgcgagagtgaggtggggctactccttccattctcattactacatgacgtctggggctcgagggacccacggtcaccgtctaccgtcacgcctaccaccaacgggccccaacgttccggtcccttccccccgtcggcccgccccgtcggcctcccgacggacgccaccgtccgg

SEQ ID NO: 410936 - DNA, 598 bp, Homo sapiens
  misc_feature: GZ8MTXP02FTFXO.25.85.H08.1.454.CMB.2.raw
  modified_base (254)..(254): a, c, t, g, unknown or other
  modified_base (583)..(583): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcgaggggtccgccaggctccgggggaagggactgggagtgggtctcagtcatttanaccgatggtcggagatactacacagagtccgtagaagggccgattcatcatgtccagagacagttccacgaacactatttctttctcatatgaacagcccctgagtgccgagacacggcatatattatgtgacgagagtgaggtggggacctacgtccttcgactttctctattactactacgttgggaccgttcggtcgggggtcctacgggaacgggacccgtaacggtccgaccgttcctcctcgacgtccttacccgaccgaacggggccctacgttccggttcccttcccccgtcggcccgcccgtcggacctcccgacggccnccgtaccgttcgggg

SEQ ID NO: 410937 - DNA, 656 bp, Homo sapiens
  misc_feature: GZ8MTXP02HRD3G.25.85.H08.1.454.CMB.2.raw
  modified_base (256)..(256): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcgagggggtccgccaggcgtccgggggaagggactgggagtgggtctcagtcatttanaccgatggtcgagatacacacagacgtccgtggaagggccgaattcatcatgtccagagacagttcccaagaacactatttcttttacttcaattagtagaaaccagtcccctaggacgtgacccggaaggaaccacgggcctaattaattaatttgttggtaggcgaaggtagtggagggtcggggccttacgtcctttcactttctctacttactactagtcggtacgttcggtgggggtctcgggacggacccgtacggtaccaccgttctccgtactacgtccttacccgaccgaaccggggtccctaacgttcccggggttcccctttccccccgtcggggtacccccgtccccgtcgcccgtaccggaacggaccgtacccgtaccggtccggg

SEQ ID NO: 410938 - DNA, 526 bp, Homo sapiens
  misc_feature: GZ8MTXP02G5KQ0.25.85.H08.1.454.CMB.2.raw
  modified_base (208)..(208): a, c, t, g, unknown or other
  modified_base (251)..(251): a, c, t, g, unknown or other
  modified_base (347)..(347): a, c, t, g, unknown or other
  modified_base (366)..(366): a, c, t, g, unknown or other
  modified_base (501)..(501): a, c, t, g, unknown or other
  modified_base (505)..(505): a, c, t, g, unknown or other
  modified_base (518)..(518): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccgggggaaggactggagtgggtctcagtcatttanaccgatggtcggagatactacacagagtccgtgaagggccgattcatcatgtccagagacagttccaacgaacactatttctttctcatatgaacngcccctgagtcgcgagacncgcatatattatgtgacgagagtgaggtcgggcctacgtcccttcacttcactattacacagtggactcgtgggctcgacgggaccacggtcaccgtctctcagtcctaccacgaggcccagtccgtcctcccgngccnccgtgctcgagcncacgtcgg

SEQ ID NO: 410939 - DNA, 560 bp, Homo sapiens
  misc_feature: GZ8MTXP02HOXQ2.25.85.H08.1.454.CMB.2.raw
  modified_base (322)..(322): a, c, t, g, unknown or other
  modified_base (345)..(345): a, c, t, g, unknown or other
  modified_base (370)..(370): a, c, t, g, unknown or other
  modified_base (380)..(380): a, c, t, g, unknown or other
  modified_base (404)..(404): a, c, t, g, unknown or other
  modified_base (515)..(515): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccgccaggctccggggaagggactgggagtgggtctcagtcatttataccgatggtcggagatactacacagagtccgtgaagggccattcatcatgtccagagacagtccagaacnctatttctttcttcatatgaacngccctgagtgccgagacacggcatntattatgtgngagagtgagtgggctactccttcnttctcattactacatggtacgtcgtggggctacggaggaccgacggtcaccgtctccgtcacgtccttccaccgtaacggccctacgttccggttccttcccccgtggccnccccgttcgacccgttacccgaacggtcgccgtaccgttccgggg

SEQ ID NO: 410940 - DNA, 594 bp, Homo sapiens
  misc_feature: GZ8MTXP02GN56H.25.85.H08.1.454.CMB.2.raw
  modified_base (208)..(208): a, c, t, g, unknown or other
  modified_base (255)..(255): a, c, t, g, unknown or other
  modified_base (260)..(260): a, c, t, g, unknown or other
  modified_base (577)..(577): a, c, t, g, unknown or other
  modified_base (586)..(586): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccagggctccgggggaagggactgggagtgggtctcgagtcatttanaccgntggtcggagatacacacagacgtccgtgaagggccgattcgatcatcgtccagagacacgttccaagaacactatttcctttctcagtatagaactgcccctgacgtgaccgaggtaccacgggcctaagtattattattggtagcgtagagtgtaaggtcggggtaccctacgttcccttcctatttctactaattactacgtagtggacgtcggtggggcttacgacgggacccacgggtcctacccgtctccctcgacgcccgttaccaccgtacggccctagtccggtcctccccgtgcccgtccgtcgtccncgacgcgcncgtccggg

SEQ ID NO: 410941 - DNA, 561 bp, Homo sapiens
  misc_feature: GZ8MTXP02GJUQL.25.85.H08.1.454.CMB.2.raw
  modified_base (208)..(208): a, c, t, g, unknown or other
  modified_base (252)..(252): a, c, t, g, unknown or other
  modified_base (284)..(284): a, c, t, g, unknown or other
  modified_base (366)..(366): a, c, t, g, unknown or other
  modified_base (382)..(382): a, c, t, g, unknown or other
  modified_base (384)..(384): a, c, t, g, unknown or other
  modified_base (422)..(422): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccnccaggctccggggaagggactgggagtgggtctcagtcatttanaccgatggtcggagatactacacagagtccgngaagggccattcatcatgccagagacagttccacgaacactatttctttctcatatgaaacagcccctgagtgccgaggacncggccatatattatgngngagagtgagtgggctactccttcattctctattactanatggacgtcgtgggctcgacggaccgacggtccaccggtctcctcacgtccttccgaacccgtacgggccctacgtccggtcccttcccccgtcggcccgtccccgtcggccttcccgacggcgcccgtaccgtccggg

SEQ ID NO: 410942 - DNA, 553 bp, Homo sapiens
  misc_feature: GZ8MTXP02G5AA9.25.85.H08.1.454.CMB.2.raw
  modified_base (326)..(326): a, c, t, g, unknown or other
  modified_base (387)..(387): a, c, t, g, unknown or other
  modified_base (426)..(426): a, c, t, g, unknown or other
  modified_base (541)..(541): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccgccaggctccgggggaagggactggagtgggtctcagtcatttataccgatgggtcggagatactacacagagtccgtgaagggccgattcatcatgtccagagacagttccacgaacnctattctttctcatatgaacagcccctgatgccgaggacacggccatatatatgtgcgagngtgaggtggggcctacgtcccttcattctctattactanagtgacgtcgtggggctcgagggaccacggtccaccgtctcctcgacgcttcccaccgtacgggcccacgttccggtccttcccccgtggccgtccccgtcgcctccgacggacnccgaccgtccgg

SEQ ID NO: 410943 - DNA, 608 bp, Homo sapiens
  misc_feature: GZ8MTXP02JPCF7.25.85.H08.1.454.CMB.2.raw
  modified_base (257)..(257): a, c, t, g, unknown or other
  modified_base (336)..(336): a, c, t, g, unknown or other
  modified_base (357)..(357): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcgagggggtccgccagggcgtccgggggaagggactgggagtgggtctcagtcatttanaccgatggtcggagatactacacagagtccgtgaagggccgattcatcatcgccagacgacacgttccaacgaacactntttctttcttcatatagaacngccctgagtcgacgaggaccacggcctatatattatgtagcgagagtgaggtcggggcctacgtccttctacttctctattactactagtcggtacgtcggtggggctacggacgggacccgtacggtcctaccgtctccgtcgacgtccttacccgaaccgaacgggcccctacgttcccggttcccgttcccccgtcggtccccgtcccgtcggtcctacccggaaggccgtaccgtaccgtccggggg

SEQ ID NO: 410944 - DNA, 731 bp, Homo sapiens
  misc_feature: GZ8MTXP02FLVY0.25.85.H08.1.454.CMB.2.raw
  modified_base (258)..(258): a, c, t, g, unknown or other
  modified_base (379)..(379): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcgaggggtcccgccgagggccgtccgggggaagggctgggagtgggtctcagtcatttanaccgagtggtacggagatactacacaggacgtccgtaggaacgggcctattcatcaatcgtccaaggacacacgttaccaacgtaaactactattttcctttctacgaattactagaaacngccccgtaggacgtacggacccggaaggaccaaccgggtctaattatttaaagtttagttgggtaggacggaagggtaagggttgggtaacggggttccgggggtacccttacccgtttcccctttaccctactttcctacttaacttaactacgtaaggttcgggtacggttcgggtcggggtaccgtacgggaaccgggtacccgtaccgggtcctacccggttcctaccctacgtacgtacccttacccgaacccggaaccgggtcccctaccggttccccggttccccgttcccccgtcggtccccgccgtccgcccgtaccggacggccgacctacccggtccgggg

SEQ ID NO: 410945 - DNA, 780 bp, Homo sapiens
  misc_feature: GZ8MTXP02JWX8H.25.85.H08.1.454.CMB.2.raw
  modified_base (209)..(209): a, c, t, g, unknown or other
  modified_base (253)..(253): a, c, t, g, unknown or other
  modified_base (264)..(264): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcgaggggtccncaggcgtccgggggaaggactgggagtgggtctcagtcatttanacgatggcganatacacacagagtccgtgaacgggccattcatcatcgtaccaagtacgactacgttcccaacgtaaacactaattttccttttactacgaattacgtacgaaactgcccctaggacgtcaccgggaggaccacgggccaattattacgtttatggtcgacgtaggtaagtggtacggtcggggtacccttacttcccctttactacttaccttactaacgtttaactacctaaggttccgggtaacggttcgggttacgggggcttaccgggaccggggtaaccctaccgggttacccgtaacccggttccgttaccccgtactaccgggttacccctttaacccccgggaaacccggtttaaacccgggggacccccctttaaacgggttcccccggggtttacccccgttttacccccccggacggggtaccccccggttaacccccggttcggcccccgttaccgggaaacccgggttaccggaccccggttaacccggtttaccccgggggg

SEQ ID NO: 410946 - DNA, 635 bp, Homo sapiens
  misc_feature: GZ8MTXP02I3LSG.25.85.H08.1.454.CMB.2.raw
  modified_base (211)..(211): a, c, t, g, unknown or other
  modified_base (261)..(261): a, c, t, g, unknown or other
  modified_base (287)..(287): a, c, t, g, unknown or other
  modified_base (325)..(325): a, c, t, g, unknown or other
  modified_base (453)..(453): a, c, t, g, unknown or other
  modified_base (503)..(503): a, c, t, g, unknown or other
tcagactgtacagtcacgaccggtgctcgatttagtatcactcagtcgcggtgaggacgctgaccacacggaacgtgctgttgtactgctcctcccgcggctttgtcttggcattatgcacctccacgcccgtccacgtaccacttgaactggacctcggggtcttcgtggctcacgtccaccaccacgcacgtgacctcgagggggtccnccgaggcgtaccgggggaaggacgtgggagtgggtctcgtagtcatttanaccgatggtcggagactactacacgngacgtccggtaggagggccgtatcatcgatgcacgganactattaccgaacgaacactactttctttccgtactatatacgaacacgtcctagacgtgaccggtagaccgacgcctaattacttattatcgtagcgtagagtcgaggtcgggtactactctacctntctatactacactagcggtacgtcggtgggtaccacgggaccggtaaccnccgggtaccctccggtacctccctacgcttacccttaccgacccggaaccgggtccccaacgttcccggttcccttcccgccggggtaccctcccgttcggacccgcggacgtaccgtaccgtaccggtcgg

SEQ ID NO: 410947 - DNA, 467 bp, Homo sapiens
  misc_feature: GZ8MTXP01EXTCR.25.61.F06.1.454.CMB.2.raw
  modified_base (446)..(446): a, c, t, g, unknown or other
  modified_base (456)..(456): a, c, t, g, unknown or other
  modified_base (462)..(467): a, c, t, g, unknown or other
tcagactgtacagtcacgaccggtgctcgatttagctacgctctaagggaaaggggctggagtgggtttcatacattagtagtagtggtagtaccatatactacgcagactctgtgagggccgattcaccatctccagggacaacgccaagaactcactgtatctgcaaatgaacagcctgagagccgaggacacggccgtgtattactgtgcgagagacagttacgatattttgactggttattagtggggggcctactactactactacatggacgtctggggcaaagggaccacggtcaccgtctcctcagcctccaccaaggcccatcggtccttccccctggccaccctcctccaagcgcacctcgtgggggcaacagccggccctggggctcgacccgtcgggtcaaaggcctaactccactgtacagtctgagcgggcnggcaagggcngatagnnnnnn

SEQ ID NO: 410948 - DNA, 445 bp, Homo sapiens
  misc_feature: GZ8MTXP01BR3WU.25.61.F06.1.454.CMB.2.raw
  modified_base (308)..(308): a, c, t, g, unknown or other
  modified_base (432)..(432): a, c, t, g, unknown or other
  modified_base (438)..(438): a, c, t, g, unknown or other
  modified_base (440)..(445): a, c, t, g, unknown or other
tcagactgtacagtcacgaccggtgctcgatttagctacgctctaagggaaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacagttacgatatttgactggttattatggggggctactactactactacatggacgctgggcaaagggaccacggtcaccgtctcctnagcctccaccaacgggcccatcggtccttcccctggccaccctctccaagacgcactcgtgggggcaacagcggccctgggctgcctggtcaagcctacttcactgaccagtctgagcgggcgngcagcnannnnnn

SEQ ID NO: 410949 - DNA, 459 bp, Homo sapiens
  misc_feature: GZ8MTXP01EOJVC.25.61.F06.1.454.CMB.2.raw
  modified_base (267)..(267): a, c, t, g, unknown or other
  modified_base (309)..(309): a, c, t, g, unknown or other
  modified_base (430)..(430): a, c, t, g, unknown or other
  modified_base (451)..(451): a, c, t, g, unknown or other
  modified_base (454)..(454): a, c, t, g, unknown or other
  modified_base (456)..(459): a, c, t, g, unknown or other
tcagactgtacagtcacgaccggtgctcgatttagctacgctctaagggaaagggactggagtggattggccatatattttacagtgggagtaccaattacaatccctccctcaagagtcgcgtcaccatatcagtagagaggtccaagaataagttctcccttaagttgagctctgtgaccgctggcggacacggccgtgtattactgtgcggaggggggtcgtttgacgtagtttttggggtgttattactaccccttattcctntcttgacctcgtggggccagggaaccctggtccaccgtctcncagccctccaccaacgggcccatccggtcctccccctggccgccctgcctccaggacgccacctccgagagcacaggcccggcccctgggcctgccctggtcaaggctacttccatgtacngtctgagcgggctggcaggcncangnnnn

SEQ ID NO: 410950 - DNA, 615 bp, Homo sapiens
  misc_feature: GZ8MTXP01CP1FL.25.61.F06.1.454.CMB.2.raw
  modified_base (222)..(222): a, c, t, g, unknown or other
  modified_base (559)..(559): a, c, t, g, unknown or other
  modified_base (588)..(615): a, c, t, g, unknown or other
tcagactgtacagtcacgaccggtgctcgatttagctacgctctaagggaaaggggctggagtgggtttcatacattagtagtagtggtagtaccatatactacgcagactctgtgaagggccgattcaccatctccagggacaacgccaagaactcactgtatctgacaaatgaacagcctgagagccgagacgacggccgtgtattactgtgcgagaganagttacgattatttgattggttattaggtgggggtcctactactactactacagtggacgtcggtagggacgtaaacgggacccgtacggtacacccgtctaccctcgaccgcccctacccaaccgaaccggcccctacgtcccggtcccctttcccccgacgccccacccccttaccctaccaacgtcccgccctaccgtcccgggtcgggggacccaaccgaccgggtcccggggcccgtcggggtcctcggtacccgtacgggtaaccgaaccgggtaaccctttaccgtacgtacccgtagtactacggttccgtagggacggtccggggacngggtacccgaagggcccaagggttagcgnnnnnnnnnnnnnnnnnnnnnnnnnnnn

SEQ ID NO: 410951 - DNA, 450 bp, Homo sapiens
  misc_feature: GZ8MTXP02JAPXP.25.61.F06.1.454.CMB.2.raw
  modified_base (445)..(450): a, c, t, g, unknown or other
tcagactgtacagtcacgaccggtgctcgatttagctacgctctaagggaaagggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacagttacgatatttgactggttattatggggggcctactactactacatggacgtctggggcaaagggaccacggtcaccgtctcctcagcctccaccaagggcccatcggtcttccccctggcaccctcctccaagagccacctctgggggcacagcggccctgggctgcctggtcaaggctacttccactgtacagtctgagcgggctgggcaaggcgcatagnnnnnn

SEQ ID NO: 410952 - DNA, 450 bp, Homo sapiens
  misc_feature: GZ8MTXP02I0U6F.25.61.F06.1.454.CMB.2.raw
  modified_base (445)..(450): a, c, t, g, unknown or other
tcagactgtacagtcacgaccggtgctcgatttagctacgctctaagggaaagggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacagttacgatatttgactggttattatggggggcctactactactactacatggacgtctggggcaaagggaccacggtcaccgtctcctcagcctcaccaaggcccatcggtcttccccctggccaccctcctccaagacgcacctctggggcacagcggcctgggctgcctggtcaaggactacttccactgtacagtctgagcgggctggcaaggcgcatagnnnnnn

SEQ ID NO: 410953 - DNA, 448 bp, Homo sapiens
  misc_feature: GZ8MTXP02IE2SI.25.61.F06.1.454.CMB.2.raw
  modified_base (337)..(337): a, c, t, g, unknown or other
  modified_base (340)..(340): a, c, t, g, unknown or other
  modified_base (352)..(352): a, c, t, g, unknown or other
  modified_base (441)..(448): a, c, t, g, unknown or other
tcagactgtacagtcacgaccggtgctcgatttagctacgctctaagggaaagggctggagtgggttggccgtattagaaataaagctaagagttacaccacagaatacgccgcgtctgtgaaaggcagattcattatctcaagagatgattcaaagaactcactgtatctgcaaatgaacagcctgaaaaccgagacacggccgtgtattactgtgctaggtcagactacggtgactctaacccctattactcctactactacatggccgtctggggacaaaagggaccacggtcaccgtctcctcagcctccaccaaggcccatcggtctccccngcncctgctccagcncacccctccgagacgcacagcggccctggggctcgcctgtcaaaggctacttccactgtacagtctgagcggctggcaaggcgcatagnnnnnnnn

SEQ ID NO: 410954 - DNA, 445 bp, Homo sapiens
  misc_feature: GZ8MTXP02IBFC6.25.61.F06.1.454.CMB.2.raw
  modified_base (443)..(445): a, c, t, g, unknown or other
tcagactgtacagtcacgaccggtgctcgatttagctacgctctaagggaaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacagttacgatattttgactggttatatggggggcctactactactactacatggacgtctggggcaaaggaccacggtcaccgtctcctcagcctccaccaaggcccatcggtcttccccctggcaccctcctccaagacgcacctctgggggcacagcgccctggcctgcctggtcaaggctacttccactgtacagtctgagcggctgcaaggcgcatagnnn

SEQ ID NO: 410955 - DNA, 437 bp, Homo sapiens
  misc_feature: GZ8MTXP02ISGKU.25.61.F06.1.454.CMB.2.raw
  modified_base (430)..(437): a, c, t, g, unknown or other
tcagactgtacagtcacgaccggtgctcgatttagctacgctctaagggaaaggggctggagtgggttggccgtattaagaccaatagtgaaggtgggacaagagactacgctgcatccgtgaaagacagattcaccatctcaagggatgattcaaagaccacgctgtatctgcagatgaacagcctgaaggtcgaggacacagccgtttattactgtacctccttgaaagcaactcgggggactactggggccagggaaccctggtcaccgtctcctcagcctccaccaagggcccatccggtctccccctggccgcccctgctccaggacgccacctccgagacgcaccagccggccctggggccctgccctggtccaaggaccttacgtccactcgtacagtctgagcgggctggcaggcgcatagnnnnnnnn

SEQ ID NO: 410956 - DNA, 448 bp, Homo sapiens
  misc_feature: GZ8MTXP02FH6ND.25.61.F06.1.454.CMB.2.raw
  modified_base (427)..(427): a, c, t, g, unknown or other
  modified_base (435)..(435): a, c, t, g, unknown or other
  modified_base (442)..(442): a, c, t, g, unknown or other
  modified_base (444)..(444): a, c, t, g, unknown or other
  modified_base (446)..(448): a, c, t, g, unknown or other
tcagactgtacagtcacgaccggtgctcgatttagctacgctctaagggaaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacagttacgatattttgactggttattatggggggcctactactactactacatggacgtctggggcaaagggaccacggtcaccgtctcctcagcctccaccaaggcccatcggtctccccctggcaccctcctccaagacgcacctctgggggcacagcggccctgggctgccctggtcaaaggactacttccactgtacagtcgngagcggcngcaggcnangnnn

SEQ ID NO: 410957 - DNA, 510 bp, Homo sapiens
  misc_feature: GZ8MTXP02HZ9K8.25.61.F06.1.454.CMB.2.raw
  modified_base (498)..(510): a, c, t, g, unknown or other
tcagactgtacagtcacgaccggtgctcgatttagctacgctctaagggaaagggactggagtggattggccatatattttacagtgggagtaccaattacaatccctccctcaagagtcgcgtcaccatatcagtagagaggtccaagaataagttctcccttaagttgagctctgtgaccgctgcggacacggccgtgtattactgtgcggagggggctttgacgtatttttggggtgttattactacccccttaattcctctctttgacctgtggggccaggggaaccctggtcaccgtctcctcacgccctccaccaagggccccagtccggtccttccccctggccgccctgcctccgaggacgccaccctccggagacgccaacgacggccccggccccgtggggcctcggcctacgggtccaggggtaccttacttccccaacgttaccaggttcctaggagcggggcctgggcgaacggccgacagtagnnnnnnnnnnnnn

SEQ ID NO: 410958 - DNA, 502 bp, Homo sapiens
  misc_feature: GZ8MTXP02H1M9D.25.61.F06.1.454.CMB.2.raw
  modified_base (489)..(489): a, c, t, g, unknown or other
  modified_base (491)..(502): a, c, t, g, unknown or other
tcagactgtacagtcacgaccggtgctcgatttagctacgctctaagggaaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacagttacgattattttgactggttattaggtggggggtcctactactactactacatggacgtcgtggggacgaaacggaccacggtcaccgtctcctcacgccctccaccgaacggcccacgtccgtccttcccccgtggccacccctcctaccaacgacccgaccacctcggtcggggcacgcgccggcccgtgggcctcgccgtcgggtacaacggtacctacctccactcgtacagtctggacggtcggactgggacacgggcanannnnnnnnnnnn

SEQ ID NO: 410959 - DNA, 455 bp, Homo sapiens
  misc_feature: GZ8MTXP02IIXRC.25.61.F06.1.454.CMB.2.raw
  modified_base (443)..(443): a, c, t, g, unknown or other
  modified_base (445)..(445): a, c, t, g, unknown or other
  modified_base (447)..(455): a, c, t, g, unknown or other
tcagactgtacagtcacgaccggtgctcgatttagctacgctctaagggaaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacagttacgatatttgactggttatatggggggcctactactactactacatggacgtctggggcaaaggaccacggtcaccgtctcctcagcctccaccaaggcccatcggtcttccccctggcaccctcctccaagacgcacctctgggggcacgagtcgcccgtggcctgaccctggtcaaggactactcactgacagtctgagcgggctgcaaaggcganangnnnnnnnnn

SEQ ID NO: 410960 - DNA, 515 bp, Homo sapiens
  misc_feature: GZ8MTXP01CDAJM.44.83.H06.1.454.CMB.2.raw
  modified_base (275)..(275): a, c, t, g, unknown or other
  modified_base (342)..(342): a, c, t, g, unknown or other
  modified_base (424)..(424): a, c, t, g, unknown or other
  modified_base (430)..(430): a, c, t, g, unknown or other
tcagacagtatatacacgaccggtgctcgatttagatcacgtgcgtcgcgggggcagaagtctctctcagtcaggacacagcatggacatgagggtccctgctcagctcctgggactcctgctgctctggctcccagataccagatgtgacatccagatgacccagtctccatccctccctgtctgcatctgtgggagacagagtcaccatcacttgccgggcgagtcagggcattagcaattattagcctggtatcagcagaaaccagggaaanctactaagctcctgatctatagaaacatccattttcgctaatcgaggggtcccaatctcgtcagcgnagtgatctgggacagtattcactctcaccgtcagcagcctgcacggctagaagatgtgctaattattactagtacaaaagtntaaacngttcgtaccccttctaacctcctttacgttccgttccgtaacgggaaccctaagtacggtaggttaataaccgttaagaaacggg

SEQ ID NO: 410961 - DNA, 551 bp, Homo sapiens
  misc_feature: GZ8MTXP01DGEL3.44.83.H06.1.454.CMB.2.raw
  modified_base (196)..(196): a, c, t, g, unknown or other
  modified_base (222)..(222): a, c, t, g, unknown or other
tcagacagtatatacacgaccggtgctcgatttagatcacgtgcgtcgcgggggcagaagtctctctcagtcaggacacagcatggacatgagggtccctgctcagctcctgggactcctgctgctctggctcccagataccagatgtgacatccagatgacccagtctccatcctcctgtctgcatctgtggganacagagtcaccatcacttggccgggngagtcagggcattagcaattattagctggtatcagcaagaaaccagggaacgctacctaagctcctgatctatagaaactatcctattttcgactaatcgtacggggtccctaacttctcggttcacggcggcagtggatcgagggacagtattcactctaccacgtcacgcacgctgacagggtcctagaagtattgttacgacttaatttattaactagtaactaaaagttataaactcgttaccgtccccttctaaacctccgttttaccgggccccttaggggaaccctaacgtaacgttggacttacgttaacgaacggtaacg

SEQ ID NO: 410962 - DNA, 661 bp, Homo sapiens
  misc_feature: GZ8MTXP01BFWN6.44.83.H06.1.454.CMB.2.raw
  modified_base (198)..(198): a, c, t, g, unknown or other
  modified_base (281)..(281): a, c, t, g, unknown or other
tcagacagtatatacacgaccggtgctcgatttagatcacgtgcgtcgcgggggcagaagtctctctcagtcaggacacagcatggacatgagggtccctgctcagctcctgggactcctgctgctctggctcccagataccagatgtgacatccagatgacccagtctccatccctcctgtctgcatcgtgtggganacagatcaccatcacgttggccggggcagtcgagggctattagactaattattagctggtatcagacaagaaaccgaggaacnctaccgtaagctctagattactatagaaactatacctatttcgactaagtcgacgggtcctaattcgttcggtcacggtcggacgtacggtggactcggtacgggaactaggtacttttccgaaccttccgtaccgtacccgttacgaacggtccaacgtcccgtagaccgtacgggtacccgttaggaaagttacgtttaggttactaaccgtttaaacttttaacgtttaacgttaaacgttaaacgttaaaaaacggttactaaaccgtaacggttcccgtaaccccttacgtaaaccgttaccccggtttccgggttccccgttagggaacccctagtaacgggttacggtaacttacttaacgaacggttaaccg

SEQ ID NO: 410963 - DNA, 564 bp, Homo sapiens
  misc_feature: GZ8MTXP01A2ROJ.44.83.H06.1.454.CMB.2.raw
  modified_base (197)..(197): a, c, t, g, unknown or other
tcagacagtatatacacgaccggtgctcgatttagatcacgtgcgtcgcgggggcagaagtctctctcagtcaggacacagcatggacatgagggtccctgctcagctcctgggactcctgctgctctggctcccagataccagatgtgacatccagatgacccagtctccatccctccctgtctgcatctgtgganacagagtcaccatcacttggccgggcagtcgagggcattagcaattattagcctggtatcagcaagaaaccgagggaaacgctacctaagctcctgactctatagaaactatacctattttcgactaatcgacggggtcccaatcgtcgttcagcggcagtggatcgtgggactagtattcactctaccaccgtcacgcacgcctagcgacggccgttagaacgtagttgttcgacgttaaactttacgttactaaggttaaccaaaaagttaactaaacgtaacgttaccgtaccccttctaacgttcccgttacccggcccgttacgggaacctacgaacgtggtacttactaacgaacgtaacg

SEQ ID NO: 410964 - DNA, 490 bp, Homo sapiens
  misc_feature: GZ8MTXP01AY6D5.44.83.H06.1.454.CMB.2.raw
  modified_base (197)..(197): a, c, t, g, unknown or other
  modified_base (222)..(222): a, c, t, g, unknown or other
  modified_base (443)..(443): a, c, t, g, unknown or other
  modified_base (472)..(472): a, c, t, g, unknown or other
tcagacagtatatacacgaccggtgctcgatttagatcacgtgcgtcgcgggggcagaagtctctctcagtcaggacacagcatggacatgagggtccctgctcagctcctgggactcctgctgctctggctcccagataccagatgtgacatccagatgacccagtctccatcctccctgtctgcatctgtggganacagagtcaccatcacttgccgggnagtcagggcattagcaattattagctggtatcagcagaaaccagggaaagctcctaagctcctgatctatgaaacatcctattttcgcaatcgagggtcccaagtctcgttcagcgcagtggatcgtgggacagtattcactcacacgtcagcagcctgcagggcctgaagatgtcgctaaccttattactagtactaaaagtataacagttcgccccttnaacctacgtttccgccttcgggaaccacngtgattactcgaagaacg

SEQ ID NO: 410965 - DNA, 574 bp, Homo sapiens
  misc_feature: GZ8MTXP01BPLNX.44.83.H06.1.454.CMB.2.raw
  modified_base (197)..(197): a, c, t, g, unknown or other
  modified_base (221)..(221): a, c, t, g, unknown or other
  modified_base (273)..(273): a, c, t, g, unknown or other
tcagacagtatatacacgaccggtgctcgatttagatcacgtgcgtcgcgggggcagaagtctctctcagtcaggacacagcatggacatgagggtccctgctcagctcctgggactcctgctgctctggctcccagataccagatgtgacatccagatgacccagtctccatcctccctgtctgcatctgtggganacagagtcacatcacttgccgggnagtcagggcatagcaattattagcctggtatcagcaagaaaccgagggaaanctacctaagctcctagatctaatagaaactatcctattttcgactaatcgacggggtcccaaagttctcggttcaacggcggacaggtggactcgtagggacaggtacttcacttcgtacaccgtcagcacgcctgcacgggcctagaagtatgttgactaactttagtactagtaactaaaagtactaaactacggttacctccccttactaaccgtaccgttttacccgggcccgttacgggggaaccctaaccgtaaggttaccgggtaattaaccgtaacgttaaacggtaacccgg

SEQ ID NO: 410966 - DNA, 689 bp, Homo sapiens
  misc_feature: GZ8MTXP01APAFG.44.83.H06.1.454.CMB.2.raw
  modified_base (197)..(197): a, c, t, g, unknown or other
  modified_base (222)..(222): a, c, t, g, unknown or other
  modified_base (275)..(275): a, c, t, g, unknown or other
tcagacagtatatacacgaccggtgctcgatttagatcacgtgcgtcgcgggggcagaagtctctctcagtcaggacacagcatggacatgagggtccctgctcagctcctgggactcctgctgctctggctcccagataccagatgtgacatccagatgacccagtctccatcctccctgtctgcatctgtggganacagagtcaccatcacttgccgggnagtcagggcattagcaattattagcctggtatcagcaagaaaccaggggaaanctacctaagctcctgatctaatgaaactatccattttcgactaatcgaacgggggtccctaaagttccgtcgggtttcaacgggtcgggtaccgtaagggttcgggtaacgttccgttacgggggaacctaagggttaacttttcccgaaccgttccctacccgtaacccgggttaccaacgggtacccaacgtccccgttacgggccaacgggggtcccctaaggtaaaccgtaacgtttgggttacgtaccgtaaaccttttattaaacccgttggtaaaccctaaaaaggttaactaaaccgtacgttacccggaccccgttacctaaccgtaacccgttttaccgggccccgttcggggtaaacccacgtaacggtaccgggtaatttacgtaacgaaacggtaacccgg

SEQ ID NO: 410967 - DNA, 584 bp, Homo sapiens
  misc_feature: GZ8MTXP01B4WC1.44.83.H06.1.454.CMB.2.raw
  modified_base (197)..(197): a, c, t, g, unknown or other
  modified_base (222)..(222): a, c, t, g, unknown or other
  modified_base (277)..(277): a, c, t, g, unknown or other
tcagacagtatatacacgaccggtgctcgatttagatcacgtgcgtcgcgggggcagaagtctctctcagtcaggacacagcatggacatgagggtccctgctcagctcctgggactcctgctgctctggctcccagataccagatgtgacatccagatgacccagtctccatcctccctgtctgcatctgtggganacagagtcaccatcacttgccgggngagtcagggcattagcaattattagcctggtatcagcaagaaaccgagggaaacnctacctaagctcctgatactatagaaactatcctattttcgacaatcgacgggtcccaaattctcggttcaggcggcaggtggatcgtgggacaggtactttcacttctacgaccgtcacgcacgcctgaccacgggccgtagaaagtacgttgttacgaacttaactttaattaacctagtaaacctaaaagttactaaacgtacgttccgtaccccttacgtaaacccttccgtttacccggccccgttacggggaaccctaacgtaaggtacgggtaacttacgttaaccgaaacggtaaccgg

SEQ ID NO: 410968 - DNA, 588 bp, Homo sapiens
  misc_feature: GZ8MTXP01DCGEF.44.83.H06.1.454.CMB.2.raw
  modified_base (198)..(198): a, c, t, g, unknown or other
  modified_base (283)..(283): a, c, t, g, unknown or other
  modified_base (363)..(363): a, c, t, g, unknown or other
tcagacagtatatacacgaccggtgctcgatttagatcacgtgcgtcgcgggggcagaagtctctctcagtcaggacacagcatggacatgagggtccctgctcagctcctgggactcctgctgctctggctcccagataccagatgtgacatccagatgacccagtcctccatcctcctgtctgcatctggtggganacagagtcacatccacttggccgggcagtcgagggctagttagctaattattagcctggtatcagacaagaaaccgagggaaacnctacctaagctacctgattctatacgaaacatactattttcgactaacgtcgacgggtcccaatcgttcggttcagcggnaggtggatcgtgggactagtacttacacgttctacgtaccgtacacgccacgtccctgaccgaggtcccgtaggtaaagtcttggttacgacttaaacgtttaactttacgtaggttaaactaaaagttaactaaacgtcgttaccgtaccccttacgtaccgttaacgtttcccggcccgttacggtaaccgactaaggttacgattactaacgaacgtaaccg

SEQ ID NO: 410969 - DNA, 669 bp, Homo sapiens
  misc_feature: GZ8MTXP01AK13H.44.83.H06.1.454.CMB.2.raw
  modified_base (198)..(198): a, c, t, g, unknown or other
  modified_base (225)..(225): a, c, t, g, unknown or other
  modified_base (278)..(278): a, c, t, g, unknown or other
tcagacagtatatacacgaccggtgctcgatttagatcacgtgcgtcgcgggggcagaagtctctctcagtcaggacacagcatggacatgagggtccctgctcagctcctgggactcctgctgctctggctcccagataccagatgtgacatccagatgacccagtctccatccctcctgtctgcatcgtgtggganacagacgtcaccatcacttggccgggngagtcgagggcatagcaattattagctggtatcagcaagaaaccgagggaacnctactaagctcctgattactatacgaaactataccgtattttacgacctaagtccgtacggggtcccctaacgttccgttccgggttcgaaacgggtccgggtacgtagggttagggtaacttccggtacgggggtaactacggttaacttttcccgaacccttcgttacccgaaccccggttacgaacggaccgttaacgccccgttacgaccgacgggtacccgtagggtaaaccgtagttacggttagacctttaaactttaacttaaccttaggtaaacctaaaaggttaactaaacgtcgttacccgaccccttactaccgttaccgttcccggcccgttacgggtaaccacgtaaggttaggacttacgtaaccgaacgtaaccg

SEQ ID NO: 410970 - DNA, 470 bp, Homo sapiens
  misc_feature: GZ8MTXP02F9P73.44.83.H06.1.454.CMB.2.raw
  modified_base (196)..(196): a, c, t, g, unknown or other
  modified_base (388)..(388): a, c, t, g, unknown or other
  modified_base (405)..(405): a, c, t, g, unknown or other
tcagacagtatatacacgaccggtgctcgatttagatcacgtgcgtcgcggggcagaagtctctctcagtcaggacacagcatggacatgagggtccctgctcagctcctgggactcctgctgctctggctcccagataccagatgtgacatccagatgacccagtctccatcctccctgtctgcatctgtggganacagagtcaccatcacttgccgggcagtcagggcattagcaattattagcctggtatcagcagaaaccagggaaagctctaagctcctgatctatgaaacatccatttgcaatcagggtccatctcggttcagcgcagtggatctgggacagattcactctcacgtcagcagcctgcagcctgagatgttanactaattatatagtaanaaagtataacagtcaccctacactacgttccgccgtacggaacacgagtacgatactacaagacg

SEQ ID NO: 410971 - DNA, 538 bp, Homo sapiens
  misc_feature: GZ8MTXP02IFAG8.44.83.H06.1.454.CMB.2.raw
tcagacagtatatacacgaccggtgctcgatttagatcacgtgcgtcgcggggcagaagtctctctcagtcaggacacagcatggacatgagggtccctgctcagctcctgggactcctgctgctctggctcccagataccagatgtgacatccagatgacccagtctccatcctccctgtctgcatctgtgggagacagagtcaccatcacttgccgggcgagtcagggcattagcaattattagcctggtatcagcagaaaccagggaaagctacctaagctcctgatctatgaaacatccatttgacaatcaggggtcccatctcggttcagcggcagtggatctgggacagatttcactctcaccgtcagcagcctgcacgcctagaagatgttgctaacttattacttagtactaaaagttactaaaacgagttcgaccccttacaacctaaccgtttcccggtcccttacgggggtaacccaaccgtaacggtttaggggaacctttaagttacccgtaaaaggtaacccgg

SEQ ID NO: 410972 - DNA, 507 bp, Homo sapiens
  misc_feature: GZ8MTXP02I5OCE.44.83.H06.1.454.CMB.2.raw
  modified_base (221)..(221): a, c, t, g, unknown or other
tcagacagtatatacacgaccggtgctcgatttagatcacgtgcgtcgcggggcagaagtctctctcagtcaggacacagcatggacatgagggtccctgctcagctcctgggactcctgctgctctggctcccagataccagatgtgacatccagatgacccagtctccatcctccctgtctgcatctgtgggagacagagtcaccatcacttgccgggnagtcagggcattagcaattattagcctggtatcagcagaaaccagggaaagctacctaagctcctgatctatgaaactatcctatttcgactaatcaggggtcccatctcggttcagcgcagtgatcgtgggacagtattcactctcaccgtcagcagcctgcagcctgaagatgtgcaaacttattactgtactaaaagtataaacagtacgacccctacacctaaccgtttccggcccgttacgggaacccacctaaggtacggaatacgtacaacgtaaccgg

SEQ ID NO: 410973 - DNA, 515 bp, Homo sapiens
  misc_feature: GZ8MTXP02GJI9R.44.83.H06.1.454.CMB.2.raw
  modified_base (222)..(222): a, c, t, g, unknown or other
  modified_base (438)..(438): a, c, t, g, unknown or other
tcagacagtatatacacgaccggtgctcgatttagatcacgtgcgtcgcgggggcagaagtctctctcagtcaggacacagcatggacatgagggtccctgctcagctcctgggactcctgctgctctggctcccagataccagatgtgacatccagatgacccagtctccatcctccctgtctgcatctgtgggagacagagtcaccatcacttgccgggnagtcagggcattagcaattattagcctggtatcagcagaaaccagggaaagctcctaagctcctgatctatgaaacatcctattttcgcaatcaggggtcccattctcggttcagtcggcagtgatctgggacagatttcactctcaccgtcagcagcctgcagcctagagatgtgactaacttattactagtactaaaagtataaacacggtacnccccctacaaccgtaccgtttcccggacccttacggggaacccaccgtaggttacggaatactaccgaagtaaccgg

SEQ ID NO: 410974 - DNA, 543 bp, Homo sapiens
  misc_feature: GZ8MTXP02GL8VA.44.83.H06.1.454.CMB.2.raw
  modified_base (197)..(197): a, c, t, g, unknown or other
  modified_base (222)..(222): a, c, t, g, unknown or other
  modified_base (360)..(360): a, c, t, g, unknown or other
tcagacagtatatacacgaccggtgctcgatttagatcacgtgcgtcgcgggggcagaagtctctctcagtcaggacacagcatggacatgagggtccctgctcagctcctgggactcctgctgctctggctcccagataccagatgtgacatccagatgacccagtctccatcctccctgtctgcatctgtggganacagagtcaccatcacttgccgggngagtcagggcattagcaattatttagcctggtatcagcagaaaccagggaaagctcctaagctcctgatctatgaaacatcctattttgacaatcaggggtcccatctcggttcagcgcagtggatcgtgggacagtnttcgactctcaccgtcagcagcctgcagcctagaacgtagtgttagactaactttattaactagtaactaaaagtactaaacgagttacgacccccttacaaccttaccgttttacccggccccgttacggggaaccctaaccgtaggttacgggaacttaacgttaccgaaaggtaacccgg

SEQ ID NO: 410975 - DNA, 519 bp, Homo sapiens
  misc_feature: GZ8MTXP02GYPY6.44.83.H06.1.454.CMB.2.raw
  modified_base (197)..(197): a, c, t, g, unknown or other
  modified_base (273)..(273): a, c, t, g, unknown or other
tcagacagtatatacacgaccggtgctcgatttagatcacgtgcgtcgcgggggcagaagtctctctcagtcaggacacagcatggacatgagggtccctgctcagctcctgggactcctgctgctctggctcctagataccagatgtgacatccagatgacccagtctccatcctccctgtctgcatctgtggganacagagtcaccatcacttgccgggcagtcagggcattagcaattattagcctggtatcagcagaaaccagggaaanctcctaagctcctgatctatagaaacatcctattttcgactaatcgaaggggttcccagttctcgggttcaggcggacagtggatcgtgggacaggtattcgactctcaccgtcagcagcctagcagcctgagtatgttcgactaactttattactagtaacaaaagttaactaacagtacgccccttacactaccttccggcccttagggaacccacgtacggtaggactacgtacaacgtaccg

SEQ ID NO: 410976 - DNA, 504 bp, Homo sapiens
  misc_feature: GZ8MTXP02JH3AR.44.83.H06.1.454.CMB.2.raw
  modified_base (197)..(197): a, c, t, g, unknown or other
  modified_base (379)..(379): a, c, t, g, unknown or other
tcagacagtatatacacgaccggtgctcgatttagatcacgtgcgtcgcgggggcagaagtctctctcagtcaggacacagcatggacatgagggtccctgctcagctcctgggactcctgctgctctggctcccagataccagatgtgacatccagatgacccagtctccatcctccctgtctgcatctgtggganacagagtcaccatcacttgccgggcagtcagggcattagcaattattagcctggtatcagcagaaaccagggaaagctacctaagctcctgatctatagaaacatcctattttcgactaatcaggggtcccatctcggttcagcggcagtggatcgtgggacagtattcactctacaccgtnagcacgctgcagctagatatgttgactaacttattactagtaactaaaatataactagtactacccctacactaccgtttccggcccgtacgggaaccacgagtacggactactacgaagtaccg

SEQ ID NO: 410977 - DNA, 522 bp, Homo sapiens
  misc_feature: GZ8MTXP02FMBQX.44.83.H06.1.454.CMB.2.raw
  modified_base (198)..(198): a, c, t, g, unknown or other
  modified_base (274)..(274): a, c, t, g, unknown or other
tcagacagtatatacacgaccggtgctcgatttagatcacgtgcgtcgcgggggcagaagtctctctcagtcaggacacagcatggacatgagggtccctgctcagctcctgggactcctgctgctctggctcccagataccagatgtgacatccagatgacccagtctccatccctccctgtctgcatctgtggganacagagtcaccatcacttgccgggcagtcagggcattagcaattattagcctggtatcagcagaaaccagggaaanctctaagctcctgatctatgaaacatcctattttcgcaagtcaggggtcccatctcggttcagcggcagtggatcgtggggacagatttcacgtctcaccgtcagcagcctagcagcctgaagatgttgactaacttattaacgtgtaactaaaagttaataaactacggtactacccctacaccgtaaccgtttccggacccttacggggaaccaccgtagtacggtatacgtacgaacgtaaccgg

SEQ ID NO: 410978 - DNA, 491 bp, Homo sapiens
  misc_feature: GZ8MTXP02HEPBN.44.83.H06.1.454.CMB.2.raw
  modified_base (222)..(222): a, c, t, g, unknown or other
  modified_base (301)..(301): a, c, t, g, unknown or other
  modified_base (357)..(357): a, c, t, g, unknown or other
  modified_base (445)..(445): a, c, t, g, unknown or other
  modified_base (451)..(451): a, c, t, g, unknown or other
  modified_base (471)..(471): a, c, t, g, unknown or other
tcagacagtatatacacgaccggtgctcgatttagatcacgtgcgtcgcgggggcagaagtctctctcagtcaggacacagcatggacatgagggtccctgctcagctcctgggactcctgctgctctggctcccagataccagatgtgacatccagatgacccagtctccatcctccctgtctgcatctgtgggagacagagtcaccatcacttgccgggngagtcagggcattagcaattattagcctggtatcagcagaaaccagggaaagctcctaagctcctgatctatgaaactntacctatttcgactaatcgacggggtcccatcgtcggttcaggcgcagtggatcgngggacagtattcgactctcaccgtcagcagcctgcagcctagaacgatgttgactaacttattactagtacaaaagtataaacagtcnccctanactacttcgcctcggaaccngacgtgatactacacgtacg

SEQ ID NO: 410979 - DNA, 572 bp, Homo sapiens
  misc_feature: GZ8MTXP02IFJ8E.44.83.H06.1.454.CMB.2.raw
  modified_base (189)..(189): a, c, t, g, unknown or other
  modified_base (221)..(221): a, c, t, g, unknown or other
  modified_base (273)..(273): a, c, t, g, unknown or other
tcagacagtatatacacgaccggtgctcgatttagatcacgtgcgtcgcgggggcagaagtctctctcagtcaggacacagcatggacatgagggtccctgctcagctcctgggactcctgctgctctggctcccagataccagatgtgacatccagatgacccagtctccatcctcctgtctgcatcngtgggagacagagtcaccatcacttgccgggnagtcaggcattagctaattattagcctggtatcagacagaaaccagggaaanctacctaagctacctgatctatagaaacatcctattttcgactaatcgacggggtaccctagttacgttcggttcaggccgggctaaggtcgggaatcgtacggggtacaggtactttcgaacttctacaccgttcacgtcacgcctagccacgaccgttagaacgtagttcgttacgaccttaatttattacgttagtaactaaaagtactaacgacgttcgccccttaacacgttaccgttccggcccgttacgggaaccctaacggagttacggtaactacgtacgaacgtaccgg

SEQ ID NO: 410980 - DNA, 606 bp, Homo sapiens
  misc_feature: GZ8MTXP02HUD2A.44.83.H06.1.454.CMB.2.raw
  modified_base (200)..(200): a, c, t, g, unknown or other
  modified_base (227)..(227): a, c, t, g, unknown or other
  modified_base (285)..(285): a, c, t, g, unknown or other
  modified_base (311)..(311): a, c, t, g, unknown or other
  modified_base (433)..(433): a, c, t, g, unknown or other
  modified_base (526)..(526): a, c, t, g, unknown or other
tcagacagtatatacacgaccggtgctcgatttagatcacgtgcgtcgcgggggcagaagtctctctcagtcaggacacagcatggacatgagggtccctgctcagctcctgggactcctgctgctctggctcccagataccagatgtgacatccagatcgacccagtcctccatccctcctgtctgcatctggtggganacagagtcaccatcacgttggccgggngtagtcgagggctattagctaattattagcctagtatcagacaagaaaccagggaaancctactaagctacctgtatacgtaanaagaaactacgtaccttatttcgacctaagtcgtaacggggtccctacgttacgtccgggttacacggcggtacgagggtgaagttccgtagggaacctagtacttcactctacctaccgtnagcacgctgacgagccgtaaggaactagttagtacaaccttaatttactaacgttacgttaaaataaaattaacgtaaactaccggttaaccncccttaacgaacccgtttaccgttacccgacccgttaaggaacctacgtaaggttaccaagtttacacgtaccgtaacgg

SEQ ID NO: 410981 - DNA, 530 bp, Homo sapiens
  misc_feature: GZ8MTXP02IB62K.44.83.H06.1.454.CMB.2.raw
  modified_base (199)..(199): a, c, t, g, unknown or other
  modified_base (227)..(227): a, c, t, g, unknown or other
  modified_base (284)..(284): a, c, t, g, unknown or other
  modified_base (313)..(313): a, c, t, g, unknown or other
  modified_base (348)..(348): a, c, t, g, unknown or other
  modified_base (362)..(362): a, c, t, g, unknown or other
  modified_base (385)..(385): a, c, t, g, unknown or other
  modified_base (451)..(451): a, c, t, g, unknown or other
tcagacagtatatacacgaccggtgctcgatttagatcacgtgcgtcgcgggggcagaagtctctctcagtcaggacacagcatggacatgagggtccctgctcagctcctgggactcctgctgctctggctcccagataccagatgtgacatccagatgacccagtctccatccctccctgtctgcatctggtggganacagagtcaccatcacgttggccggggnagtcgagggcattagctaattatttagcctggtatcagacaagaaaccaggggaaanctacctaagctcctgatctatagaaactntacctatttcgacaatcgagggtcctatcgtcgtnagcgcagtgatcgnggacagtatttcactctcacgtnacgctacgcctgcagccttagaagtactgtcacttaacttatactagtaactaaaagtactaaacncgtcaccctacgtaaccttccgtttaccggccctacgggaaccctagaggttacggaacttacgtaacgtaacgaaccg

SEQ ID NO: 410982 - DNA, 792 bp, Homo sapiens
  misc_feature: GZ8MTXP02GXG0D.44.83.H06.1.454.CMB.2.raw
  modified_base (171)..(171): a, c, t, g, unknown or other
  modified_base (234)..(234): a, c, t, g, unknown or other
tcagacagtatatacacgaccggtgctcgatttagatcacgtgcgtcgcgggggcagaagtctctctcagtcaggacacagcatggacatgagggtccctgctcagctcctgggactcctgctgctctggctcccagataccagatgtgacatccagatcgacccagtccnccactccctccctgtcctgcctatcgtggtggagacagacgtcacctatctacgttggccggngagtcgagggctattagctaaattacttagcccttaggtaactcgaacgacgaaacggaaacccgaaaggggaaaactccgtaaccgtaagccctaccgtagaaccttactaatacgaaactacttacccgttaatttttacccggacctaagttaccggtaccggggttaccccctaaagtttcccggttcggggttacccgaaacggggttccccgggagttaacggggtacggggtacgttacccggggtttaagggaaaccgttaacggttaacccgttttacccgaaaccctttcccgttacccgtaaaccccggttcgaaacgggtcccaaaccgggtccccttaccgaacccgttaccgaccccgtaaaggtaaacgttcggttacgtacggtaaacccttaacggtttaaactttaacgttacggttaaaacctaaaagttaaccctaaacgtaccggttccctaaccccgttactaacccgttaccgtttacccggtcccgtaacgggaaccctagtacgtacgtaacgttacgaacgtacgaacccgg

SEQ ID NO: 410983 - DNA, 536 bp, Homo sapiens
  misc_feature: GZ8MTXP01CRUXT.9.70.G04.1.454.CMB.2.raw
  modified_base (217)..(217): a, c, t, g, unknown or other
  modified_base (221)..(221): a, c, t, g, unknown or other
  modified_base (498)..(498): a, c, t, g, unknown or other
  modified_base (522)..(522): a, c, t, g, unknown or other
tcagtgatacgtctcacgaccggtgctcgatttagtgtagtgtgaagggaagggcctgtgaagccttcacaggccctgtccctcacctgcactgtctctggtgactccatcagaggtggtcgttcctactggacctggatccggcagtccgccggcaagggactggagtatattggacgaatctatgccagtggaccgccatctacaacccgtcctnaagngtcgagtcagcatgtcagtcgacacgtcccagaaccagttctccctgacagtgagttatatgaccgccgcagacacggccgtgtattactgtgcgagagaggccgttatttaggacagcctagttaaaactcctactacgtctggcgtctggggcaggggaccaagggtcaccgtctcctcacgcctccaccgaacgggcccatccggtccttcccctggccgccctggctccgaggacgcaccctccgagacgcacagccggccctgggcttgccnggtcaaggcttcttccaagacgtntcacttgcgcggcg

SEQ ID NO: 410984 - DNA, 619 bp, Homo sapiens
  misc_feature: GZ8MTXP01DT1E5.9.70.G04.1.454.CMB.2.raw
  modified_base (233)..(233): a, c, t, g, unknown or other
  modified_base (322)..(322): a, c, t, g, unknown or other
  modified_base (341)..(341): a, c, t, g, unknown or other
  modified_base (345)..(345): a, c, t, g, unknown or other
  modified_base (354)..(354): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtgtcttcctatggacctggatccggcagtccgcggcaagggctggatatattggacaatctatgccagtgggaccncatcaccacccccgtccanaagngtcgaatcngcatcgtacaggtaccgaacacccgtacccaacgaacctacgttcctccgtagaacgtagtagtaagttaatacgtacgaccgccgacgaacgaaccgaccggtaccgttagttaacttacgtggtacgacggtaaggacggtacggttaccgtttaagtttaacggaaccgtaacgttacgttaaacgttaaaaaccttaccgttaacgttacggtaacgtacggtaacgtcgtacggttacggtaaccggaacggggtaaccg

SEQ ID NO: 410985 - DNA, 546 bp, Homo sapiens
  misc_feature: GZ8MTXP01A2PVZ.9.70.G04.1.454.CMB.2.raw
  modified_base (199)..(199): a, c, t, g, unknown or other
  modified_base (447)..(447): a, c, t, g, unknown or other
  modified_base (540)..(540): a, c, t, g, unknown or other
tcagtgatacgtctcacgaccggtgctcgatttagtgtagtgtgaagggaaagggcctgtgaagccttcacaggccctgtccctcacctgcactgtctctggtgactccatcagaggtggtcgttcctactggacctggatccggcagtccgccggcaagggactggagtatattggacgaatctatgccagtggaccnccatctacaacccgtccctcaagagtcgagtcagcatgtcagtcgacacgtcccagaaccagttctccctgacagtgagttatatgaccgccgcagacacggccgtgtattactgtgcgagagaggccgttatttaggaccagcctagttaaaaactcctactacggtctgggcgtctggggccaggggaccaagggtcaccgtctcctcagcctccaccgaagggccccatccggtccttcccccgnggccgccctgggcctccgaggacgccacctccgagacgcacagcggccctgggcttgccttggtcaaggcttcttccaagcgtaatcacttgngcgggc

SEQ ID NO: 410986 - DNA, 530 bp, Homo sapiens
  misc_feature: GZ8MTXP01B4CIA.9.70.G04.1.454.CMB.2.raw
  modified_base (233)..(233): a, c, t, g, unknown or other
  modified_base (323)..(323): a, c, t, g, unknown or other
  modified_base (340)..(340): a, c, t, g, unknown or other
  modified_base (344)..(344): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtgtcgttccactggacctggatccggcagtccgccggcaagggctggagtatattggacaatctatgcagtggaccncatcacacccccgtccnaagngtcgaagtcaagcatgtcagtcgacacgtccagaccagtctcctgacagtgagttatatcgaccgccgcgagacacggccgtgtattactgtgcgagagaggtccgttaatttacggaccagctagttaaaacttccttacttacggtctggaacgtcgtcggggcgtaacggggaaccgtaacgg

SEQ ID NO: 410987 - DNA, 547 bp, Homo sapiens
  misc_feature: GZ8MTXP01D8CAM.9.70.G04.1.454.CMB.2.raw
  modified_base (286)..(286): a, c, t, g, unknown or other
  modified_base (329)..(329): a, c, t, g, unknown or other
  modified_base (347)..(347): a, c, t, g, unknown or other
  modified_base (352)..(352): a, c, t, g, unknown or other
  modified_base (408)..(408): a, c, t, g, unknown or other
  modified_base (442)..(442): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacgggccctgtccctcacctgcactgtctctggtgactccatcagaggtggtcgttcctactggacctggatccggcagtccgccggnaaaggggctggagtatattggacgaatctatgccagtggaccncatcacaacccgtccccncaagngtcagtcagcatgtcagtcgacacgtcccagaccagtctccctgacagtgagttanatcgaccgccgcaggacacggccgtgtattacgngtgacgagagaggtccgttagtttaacgggaccagtacttaagttaaaacctccttaacgttcggttctggacgtcgtcgggacgacggggaaccaagggtcccg

SEQ ID NO: 410988 - DNA, 562 bp, Homo sapiens
  misc_feature: GZ8MTXP01DZ0RW.9.70.G04.1.454.CMB.2.raw
  modified_base (235)..(235): a, c, t, g, unknown or other
  modified_base (246)..(246): a, c, t, g, unknown or other
  modified_base (329)..(329): a, c, t, g, unknown or other
  modified_base (354)..(354): a, c, t, g, unknown or other
  modified_base (358)..(358): a, c, t, g, unknown or other
  modified_base (368)..(368): a, c, t, g, unknown or other
  modified_base (553)..(553): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcagggagtcgggcccaggactagtgaagccttcacaggcccctgtccctcacctgcactgtctctggtnactccatcagnggtggtcgtcctatggacctggatccggcagtccgccggacaagggctggatatattggacgaatctatgccagtcgggaccnccatcctacaaccccccgtccctanaagngtcgaagtcngcatcgtcagtcacaccgtcccagaaccacgttctcctagacagtagtagttatagtcgaccgccgacgacgacgacggccgtagtattactggtcgacgagacgacggtccgtttaagtttacggactagttacgttaagttaaaacttccgttacgttacgtctggaacgtcgtgcggtccgngggtaaccg

SEQ ID NO: 410989 - DNA, 664 bp, Homo sapiens
  misc_feature: GZ8MTXP01B4ACA.9.70.G04.1.454.CMB.2.raw
  modified_base (233)..(233): a, c, t, g, unknown or other
  modified_base (332)..(332): a, c, t, g, unknown or other
  modified_base (355)..(355): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtggtcgttccactggacctggatccggcagtcccgccggcaagggctggatatagttggacgaatctatcgccaggtcgggacccncatcctaccaccccccgtcctanaagcgtcgaaagtcaagctagtcgtacacgtccgaacacccgtacccaacgtaaccctacgttcctacccgtacgaacgtaggttagtaagttaatacgtcggacccgaccgacggaacgaaccgaccggtaccgttagttaacgttacgtggtacggacggtaaggtacggtacgggttccgtttaaaggtttaacggaccgtaagttaccgttaaacgttaaaacccttcccgttaacgttaccggttcggtacgggtaaccggttcgggtacgggggttacccgtaacggggttaacccgtaacgg

SEQ ID NO: 410990 - DNA, 546 bp, Homo sapiens
  misc_feature: GZ8MTXP01B8U5V.9.70.G04.1.454.CMB.2.raw
  modified_base (233)..(233): a, c, t, g, unknown or other
  modified_base (327)..(327): a, c, t, g, unknown or other
  modified_base (346)..(346): a, c, t, g, unknown or other
  modified_base (350)..(350): a, c, t, g, unknown or other
  modified_base (360)..(360): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtgtcgttcctactggacctggatccggcagtccgccggcaaggggctggagtatattggacaatctatgccagtgggaccncatctacacccccgtcctnaagngtcgaagtcngcatgtcagtcgacaccgtcccagaccagttctccctgacagtgagttatatcgaccgccgcgacgacgaccggccgtgtattactgtgcgagagaggtccgttaagtttacggacctagcgttaacgttaaaacttccgttacttacggtctggtaacgttctggttcggccgaaggggtaaccg

SEQ ID NO: 410991 - DNA, 573 bp, Homo sapiens
  misc_feature: GZ8MTXP01DSW1R.9.70.G04.1.454.CMB.2.raw
  modified_base (215)..(215): a, c, t, g, unknown or other
  modified_base (234)..(234): a, c, t, g, unknown or other
  modified_base (331)..(331): a, c, t, g, unknown or other
  modified_base (349)..(349): a, c, t, g, unknown or other
  modified_base (353)..(353): a, c, t, g, unknown or other
  modified_base (414)..(414): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtcccctnacctgcactgtctctggtnactccatcagaggtgtcttcctactggacctggatccggcaggtcccgccggacaaggggctggagtatattggacaatctatgccagtcgggaccncatcacacccccgtccanaagngtcgaatcaagcatgtcagtcgacacgtcccagaacctagtcctccctgacagtgagttanatcgaccgccgacgacgaccgacggccgtgtacttacgtgtgcggtagaggtacggtccgtttaagttttacggacctaggacttaaacgttaaaacttccttaacgttacggtcgtaggtaaccgtcgtcggttacgggccgttaacggggtaacccg

SEQ ID NO: 410992 - DNA, 548 bp, Homo sapiens
  misc_feature: GZ8MTXP01BI0K1.9.70.G04.1.454.CMB.2.raw
  modified_base (199)..(199): a, c, t, g, unknown or other
  modified_base (479)..(479): a, c, t, g, unknown or other
  modified_base (531)..(531): a, c, t, g, unknown or other
  modified_base (534)..(534): a, c, t, g, unknown or other
tcagtgatacgtctcacgaccggtgctcgatttagtgtagtgtgaagggaaagggcctgtgaagccttcacaggccctgtccctcacctgcactgtctctggtgactccatcagaggtggtcgttcctactggacctggatccggcagtccgccggcaagggactggagtatattggacgaatctatgccagtggaccnccatctacaacccgtcctcaagagtcgagtcagcatgtcagtcgacacgtcccagaaccagttctccctgacagtgagttatatgaccgccgcagacacggccgtgtattactgtgcgagagaggccgttatttaggacagcctagttaaaactctactacgtctggcgtctggggcaggggaccaagggtcaccgtctctcagcctccacaacgggcccatcggtccttccccgtgccgccctgggctcgacgggacgccaccctccgagacgccaacngccggccccgtgggccttgcccttggtcaagggaccttcttccaagtccgtntcncttggaagcgggcg

SEQ ID NO: 410993 - DNA, 534 bp, Homo sapiens
  misc_feature: GZ8MTXP01AO8CH.9.70.G04.1.454.CMB.2.raw
  modified_base (234)..(234): a, c, t, g, unknown or other
  modified_base (319)..(319): a, c, t, g, unknown or other
  modified_base (337)..(337): a, c, t, g, unknown or other
  modified_base (341)..(341): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtccctcacctgcactgtctctggtnactcatcagaggtgtcttcatggacctggatccggcagtccgccgcaagggctggatatatggacaatctatgccagtcggaccncatctacaccccgtccanaagngtcgaagtcaagcatgtacagtcgacacgtcccagaaccagttctccctgacagtgagttatatcgaccgccgacagacacggccgtgtacttacgtgtgcgagagacggtcgttaatttaggacagttacgtacgttaaaacttccttacttacggtctggaacgttcgtggttcggtccgaaggggaaccg

SEQ ID NO: 410994 - DNA, 646 bp, Homo sapiens
  misc_feature: GZ8MTXP01AWL2D.9.70.G04.1.454.CMB.2.raw
  modified_base (235)..(235): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtcccctcacctgcactgtctctggtnactccatcagaggtgtcttcctactggacctggatcccggcacggtcccgccgggacaaggggactgggagtattagttgggaacgtaaattcgtaatcggacccgaagggtcgggggacccctcccaattcccgtaacccaaaccccccccggttcccctacgaaaggtacgtccgaaagtccaagcagtcgtacagtcgacaccgtcccagacctacgtctccctgacagtagtagttatacgtcgaccgccgacgacgacgccggccgtgtactacgtgtgacgagtaggtacggtccgtttaagtttacggacctaggttacttaaacggttaaaacccttccgttacgttacggttcgtacgggtaacggtcggtcggggaccggaacggggttaaccgtaacggg

SEQ ID NO: 410995 - DNA, 540 bp, Homo sapiens
  misc_feature: GZ8MTXP01AIH58.9.70.G04.1.454.CMB.2.raw
  modified_base (234)..(234): a, c, t, g, unknown or other
  modified_base (326)..(326): a, c, t, g, unknown or other
  modified_base (346)..(346): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtccctcacctgcactgtctctggtnactccatcagaggtgtcgttcctactggacctggatccggcagtccgccggcaagggctggagtatatggacaatctatgccagtgggaccncatctaccacccccgtcctnaagacgtcgaagtcaagcatgtcagtcgacacgtccagaccagtctcctgacagtgagttatatcgaccgccgcgagaccgacgccgtgtattactgtgcgagagtacggcgttaagtttagacacgcgtagttaaaacttccttacgttacgtcgtggaacgtcggtcgggaccgaacggggaacgtaacggg

SEQ ID NO: 410996 - DNA, 569 bp, Homo sapiens
  misc_feature: GZ8MTXP01BD3AH.9.70.G04.1.454.CMB.2.raw
  modified_base (235)..(235): a, c, t, g, unknown or other
  modified_base (328)..(328): a, c, t, g, unknown or other
  modified_base (351)..(351): a, c, t, g, unknown or other
  modified_base (355)..(355): a, c, t, g, unknown or other
  modified_base (365)..(365): a, c, t, g, unknown or other
  modified_base (404)..(404): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtcccctcacctgcactgtctctggtnactccatcagaggtgtcttcctatggacctggactccggcagtccgccggcaagggctggatatattggacaatctatgccaggtcgggaccncatctaccaaccccccgtcctanaagngtcgaagtcngcatgtcagtcgacaccgtcccagaccagtctcctgacngtacgagttatatcgaccgccgcgacgacgacggcgtgtacttacgtgtgcgtagagacggtccgttaagtttacggacctagttcgttaacgttaaaacttccgttacgttacggttcgtacgggcgttacggtcggggaccgtaacggggaaccgtaaccggg

SEQ ID NO: 410997 - DNA, 546 bp, Homo sapiens
  misc_feature: GZ8MTXP01BFH96.9.70.G04.1.454.CMB.2.raw
  modified_base (233)..(233): a, c, t, g, unknown or other
  modified_base (326)..(326): a, c, t, g, unknown or other
  modified_base (353)..(353): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtggtcgttccatggacctggatccggcagtccgccggcaagggctggatatattggacgaatctatgccagtcgggaccncatctaccaaccccccgtcctacaagngtcgaagtcaagcatgcagtcgacacgtccagacagtctcctgacagtgtagtactagtcgaccgccgcgacgaccgacggccgttgtagttactgtgcgtagacgaggtccgttaatttacggactagcttaacgtaaaacttccgttacgttacgtcgtggaacgtcgtcgggccgtaacgggcgtaacgg

SEQ ID NO: 410998 - DNA, 575 bp, Homo sapiens
  misc_feature: GZ8MTXP01D58JB.9.70.G04.1.454.CMB.2.raw
  modified_base (234)..(234): a, c, t, g, unknown or other
  modified_base (335)..(335): a, c, t, g, unknown or other
  modified_base (360)..(360): a, c, t, g, unknown or other
  modified_base (375)..(375): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtccctcacctgcactgtctctggtnactccatcagaggtgtcgttcctatggacctggactccggcacgtccgccggcaagggctggagtatagttaggacgtaatctatgcccaggtcgggaccncatcctaccgaaccccccgtcctanaagcgtcgaaagtcngcatgtcagtcgacaccgtccacgacctagtctcctagacagtgtagtatatcgaaccgccgacgaacgacacgaccgtgtactactgtagcgtagagacggtccgtttaatttaggacctagttacgttaagttaaaaccttccgttacgttacggtctcggtaaccgtcgtacggggacgtaacgggaacgtaaccgg

SEQ ID NO: 410999 - DNA, 570 bp, Homo sapiens
  misc_feature: GZ8MTXP01DUH4U.9.70.G04.1.454.CMB.2.raw
  modified_base (200)..(200): a, c, t, g, unknown or other
  modified_base (216)..(216): a, c, t, g, unknown or other
  modified_base (220)..(220): a, c, t, g, unknown or other
tcagtgatacgtctcacgaccggtgctcgatttagtgtagtgtgaagggaaagggcctgtgaagccttcacaggccctgtccctcacctgcactgtctctggtgactccatcagaggtggtcgttcctactggacccggatccggcagtccgccggcaagggactggagtatattggacgaatctatgccagtgggaccncatctacacccgtccnaagngtcgagtcagcatgtcagtcgacacgtcccagaaccagttctccctgacagtgtagttatatgaccgccgcagacacggcgtgtattactgtgcgagaggaggtccgtttatttaggaccagcttacgttaaaactctactacgtctaggacgtcgtggggccgaaggggaccaagggtcaccgtctcctcacgcctcaccgaacgggcccagttccggtcttcccccgtggccgccctgcgtcccgaggacgccacctccgagacgacacgtgccgtcccgtgggctcgccgtggttacgaacggtacttaccgttcacgtcgtatccgactggacgtcgggcgtcggg

SEQ ID NO: 411000 - DNA, 576 bp, Homo sapiens
  misc_feature: GZ8MTXP01BZ0BD.9.70.G04.1.454.CMB.2.raw
  modified_base (214)..(214): a, c, t, g, unknown or other
  modified_base (233)..(233): a, c, t, g, unknown or other
  modified_base (330)..(330): a, c, t, g, unknown or other
  modified_base (352)..(352): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctnacctgcactgtctctggtnactccatcagaggtgtcgttccactggacctggatccggcaggtcccgcggacaaggggctggagtatagtggacaatctatgccaggtcgggaccncatctaccaacccccgtcctanaagagtcgaagtcaagcatgtcagtcgacaccgtcccagaaccacgtcctccctgactagtgagttatatcgaccgccgcgaagaccgacggcgtagtattacgtgtagcgagacgtacggtccgtttaagtttacgacctaagttacgtaaacgttaaaaccttccgttacttaacggtcgtcggtaacgtcgtcgggggacctaacggggaaccgtaacggg

SEQ ID NO: 411001 - DNA, 588 bp, Homo sapiens
  misc_feature: GZ8MTXP01DYAOG.9.70.G04.1.454.CMB.2.raw
  modified_base (234)..(234): a, c, t, g, unknown or other
  modified_base (245)..(245): a, c, t, g, unknown or other
  modified_base (340)..(340): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtccctcacctgcactgtctctggtnactccatcagnggtgtcgttcctatggacctggactccggcagtcccgcggcaagggctggaatatagttggaacgtaattctaagtgacccaggtcggggacccnccaatccgtaaccaacccccccggtccctagaagtcgtcgaaagtcaagcagtgtcagtcgacaccgtccagaccagtctcctgactagtgtatatagtcgaccgccgacgacgtacgaccggtccgtagttacttacgtgtagcgagagacggtccgttaagtttacggacctagttacgttaaacgttaaaaccttccgttacgttacggtctaggtaacgtcgtggttcggccgaagggtaaccg

SEQ ID NO: 411002 - DNA, 685 bp, Homo sapiens
  misc_feature: GZ8MTXP01EFW82.9.70.G04.1.454.CMB.2.raw
  modified_base (234)..(234): a, c, t, g, unknown or other
  modified_base (290)..(290): a, c, t, g, unknown or other
  modified_base (344)..(344): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctcgtggtnactcatcaggaggtgtcgttcctagtggacctggactccggcacggtccgccgganaagggctggaagtatagttgggaactaaattctagtgacccgaggtcgggaccnctatcaaccaaccccccgtcctacaagacgtcgaacgtcaagctagtcgtacagtccgactaccgtcccagaacctgtacctcctagactagtagtaagttactacgtacgaaccgccgacggaacgaccggtaaccggtcccggtattaaaccggtttacgtacggtacggacggtaagggtacggtaacgggttacgtttaaacggtttaacggaaccgtaacgttaaccgttaaaaccggtttaaaacccgttccgttaacggttacggttaaccggtacgggtaaccgggttaccgggtaccggggttaccgggtaaccgggttaacccggtaacgg

SEQ ID NO: 411003 - DNA, 531 bp, Homo sapiens
  misc_feature: GZ8MTXP01DJORM.9.70.G04.1.454.CMB.2.raw
  modified_base (235)..(235): a, c, t, g, unknown or other
  modified_base (330)..(330): a, c, t, g, unknown or other
  modified_base (352)..(352): a, c, t, g, unknown or other
  modified_base (356)..(356): a, c, t, g, unknown or other
  modified_base (507)..(507): a, c, t, g, unknown or other
  modified_base (513)..(513): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtcccctcacctgcactgtctctggtnactccatcagaggtgtcgttcctactggacctggatccggcagtccgccggcaagggactggagtatatggacgaatctatgccaggtgggaccncatctacaaccccccgtcctanaagngtcgaagtcaagcatgtcagtcgacaccgtcccagaaccagtctccctgacagtgagttatatcgaccgccgcgacgacgacggccgtgtattactgtgcgagagaggcgttaatttaggacctagctaagtaaacttcgttacttacgtntggctntgttgccgaagggaaccg

SEQ ID NO: 411004 - DNA, 579 bp, Homo sapiens
  misc_feature: GZ8MTXP01ALBYC.9.70.G04.1.454.CMB.2.raw
  modified_base (233)..(233): a, c, t, g, unknown or other
  modified_base (330)..(330): a, c, t, g, unknown or other
  modified_base (354)..(354): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtgtcgttcctacgtggacctggatccggcacgtccgccggcaagggctggatatattggacgaatctatgcccaggtcggaccncatctaaccaaccccccgtcctanaagagtcgaaagtcaagcatgtcagtcgacaccgtcccagaaccagtcctccctgaccagtgtagttatatcgaccgccgacgacgacgacggccgtagtattacgtgtcgcgtagaggtacggtccgtttaagtttacggacctagttacgttaacgttaaaaaccttccgttaacgttaccggtctcggtaacgttctcggttcgccgttaaggggtaacccg

SEQ ID NO: 411005 - DNA, 579 bp, Homo sapiens
  misc_feature: GZ8MTXP01CU12R.9.70.G04.1.454.CMB.2.raw
  modified_base (233)..(233): a, c, t, g, unknown or other
  modified_base (326)..(326): a, c, t, g, unknown or other
  modified_base (348)..(348): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtgtcttcctacgtggacctggactccggcacgtcccgcggcaagggctggatatatggacaatctatgcaggtcggaccncatctacaaccccccgtcctanaagcgtcgaagtcaagcagtcgcagtcgacaccgtacccagaacctacgttcctccctagactacggtagtagttatacgtcgaccgccgacgacgaccgaccggtaccgtgtactacgtgtgcgtagagtacggtccgttaagtttacggactagttacgttaaagttaaacttccgttacgttacggtcgtaggtaacgttcgtcggttcggtccgaaggggtaacccg

SEQ ID NO: 411006 - DNA, 790 bp, Homo sapiens
  misc_feature: GZ8MTXP01A3KDY.9.70.G04.1.454.CMB.2.raw
  modified_base (357)..(357): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgcactgtctctggtgactccatcaggaggttggtcgttcctacgtcggacctggacgtccggcgacgtcccggccggacgaacgggcgtaggagtattagttggaacgtaattctagtcggaccgagggtcgggaccnccacttacctaacccaacccccccgtacctacgaaaggtacggttcccgaaagttacccaagtaccgtaacgttcggtaccgtaaccggttacggaaaccccgtaacccgttaccccgaaagtaaacccccgttacgtttaacccctccccggttaaggaaccgtaaggtttacggtaaacggtttacttaacgtacccggacccggtaccccggacggggaaaccggaaaccggttacccggggtaccggttacgtttaacgttaccgttgggtacggacgggtaaaggtaacggtaccgggtaacccggtttttaaagtttaacggaactaaacgggttacttaaaacgtttaaaaaccctttccgaagttacccggttgtccgggaaccggttcggcggggggacccgtaacgggaacccggtaaccggg

SEQ ID NO: 411007 - DNA, 648 bp, Homo sapiens
  misc_feature: GZ8MTXP01ERPJF.9.70.G04.1.454.CMB.2.raw
  modified_base (233)..(233): a, c, t, g, unknown or other
  modified_base (343)..(343): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctccagatgggtcctgtcccaggtgcggctgcaggagtcgggcccaggactagtgaagccttcacacggccctgtccctcacctgcactgtctctggtnactcatcagaggtgtcgttcctatggacctggactccggcacggtcccgccggacaagggactggaatatagttggaacgtaattcgtatcgacccgaggtcgggacccncatcctaaccgaacccccccgtcctagaagtcgtacgaagtcaagctagtcgtacagtccgactaccgtacccacgaacctcgttcctcccgtagtaacctaggttagtaacgttaatacgtacgacccgcccgacggaacgaccgaccggtccgttagtacttacgtgtacgcggtagacggtacggtaccgtttaagtttacggaaccgtacgttaacgttaaacgttaaaaccttccgttaacgttacggtccgtagggtaacgtcggtcggggaccggtaacggggttaaccgtaaccggg

SEQ ID NO: 411008 - DNA, 585 bp, Homo sapiens
  misc_feature: GZ8MTXP01BOZSS.9.70.G04.1.454.CMB.2.raw
  modified_base (233)..(233): a, c, t, g, unknown or other
  modified_base (331)..(331): a, c, t, g, unknown or other
  modified_base (371)..(371): a, c, t, g, unknown or other
  modified_base (556)..(556): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtgtcgttccactggaccctggactccggcagtccgccggcaaggggctggaagtatattggacaatctatgccaggtcgggaccncatcctaccaaccccccgtcctacgaagtagtcgaagtcngcatgtcagtcgacacgtaccacgaccagtctccctgacagtgacgttatacgtcgaccgccgacgacgaccgtaccggccgttgtacttacgtgtcggcgtacgaggtacggttccgttaagtttacggacctagttcgttaaacgttaaaacttccgttacgttacggtctcggtcgtccggnggggttaccgaacggggaaccgtaacggg

SEQ ID NO: 411009 - DNA, 622 bp, Homo sapiens
  misc_feature: GZ8MTXP01CXHVG.9.70.G04.1.454.CMB.2.raw
  modified_base (235)..(235): a, c, t, g, unknown or other
  modified_base (340)..(340): a, c, t, g, unknown or other
  modified_base (433)..(433): a, c, t, g, unknown or other
  modified_base (568)..(568): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgcactgtctcgtggtnactccatcagtggtcgtcgttccacgtggacctggactccggcacggtcccgcggacaagggctggaatatagtggacgtaatctatcgacctaggtcgggaccncctatcctaaccgaacccccccgtcctacgaaggtcgtaccgaagtacaagctaagtcgtacacgtacgacaccgtacccagaacctgttccnccctagaactgtagtacgttatacgtgaaccccgcgacgaacgacgtaccggtacgttgtaagttcgtgtacgcgtaaggtggaacgttccgtttaaattcggactcgaacgttaaacgttaaaccttaccgttnttaaaccggttgtacggtaacggtcctgggttacgggccgaacgggggtaaccg

SEQ ID NO: 411010 - DNA, 538 bp, Homo sapiens
  misc_feature: GZ8MTXP01D0CEJ.9.70.G04.1.454.CMB.2.raw
  modified_base (234)..(234): a, c, t, g, unknown or other
  modified_base (244)..(244): a, c, t, g, unknown or other
  modified_base (328)..(328): a, c, t, g, unknown or other
  modified_base (354)..(354): a, c, t, g, unknown or other
  modified_base (359)..(359): a, c, t, g, unknown or other
  modified_base (400)..(400): a, c, t, g, unknown or other
  modified_base (410)..(410): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtccctcacctgcactgtctctggtnactcatcagnggtgtcgttctactggacctggatccggcagtccgccggcaagggctggagtatattggacaatctatgcccaggtcgggaccnccatccaaccaaccccccgtccctanaaagngtcgaaatcaagcaatgtcagtcgacacgtccagaccatcncctgacagtnagtatagtcgaccgccgacgacgacgacggaccgtgtatactgtgcgagagacgtccgttaatttaggactagctaagtaaacttcttacttacgtctggaacgtcgtgggccgaacgggccgaacgg

SEQ ID NO: 411011 - DNA, 639 bp, Homo sapiens
  misc_feature: GZ8MTXP01C0R1Y.9.70.G04.1.454.CMB.2.raw
  modified_base (458)..(458): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctgtgtgactccatcgagtaggtgtctctagtcgactggactccggcacgtccgccggacgaaggctggagtatagttaggaactaatctagtcgacccgtaggtaccgggaccgcctatcctaacccgaacccccccgttccctacgaagtacgtcgaaaacgtccaaggactagtcgtcgacgtcgactacccgtccaacgacctacgtctccgtagactagtgtacttanacgtacgacccgtccgagaacgaccgaccggtccgttagttacttacgtgtacggacggaagtacgggtacgttcgtttaacgtttaacgggacctggttaactttaaacggttaaaacttccgttacgttacggtcgtacgggtctacgggtcggggaccgtaacggggaactaaccggg

SEQ ID NO: 411012 - DNA, 605 bp, Homo sapiens
  misc_feature: GZ8MTXP01COZBV.9.70.G04.1.454.CMB.2.raw
  modified_base (234)..(234): a, c, t, g, unknown or other
  modified_base (342)..(342): a, c, t, g, unknown or other
  modified_base (367)..(367): a, c, t, g, unknown or other
  modified_base (371)..(371): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtccctcacctgcactgtctctggtnactccatcagaggtgtcgttcctacgtggacctggactccggcaggtcccgccggcaaggggctggagtatagttggaacgtaatctagtcgacccaggtcgggaccnccatcctaccaaccccccgtcctanaagngtcgaatcaagcatgtcagtcgacaccgtcccagaacctagttcctccctagacagtgtagttatactcgaccgccgacgacgacgacggccgtagtacttacgtgtacgcgtagacggtacggtccgtttaagtttaacggacctagttacgttaaacgttaaaaccttccgttaacgttacgggtctgggtaacgtcggtacggggaccgtaacgggggaacccgtaacggg

SEQ ID NO: 411013 - DNA, 633 bp, Homo sapiens
  misc_feature: GZ8MTXP01BG8TA.9.70.G04.1.454.CMB.2.raw
  modified_base (335)..(335): a, c, t, g, unknown or other
  modified_base (450)..(450): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcggcccaggactagtgaagccttcacacggccctgtccctcacctgcactgtctctggtgactcatcagaggtgtcgttccagtggacctggactccggcacggtcccgccggcgaaagggctggatatagttggaacaatctatgacctaggtcgggaccncatcctaaccaacccccccgtcctacaagtacgtcgaagtcaagcagtgtaccagtccgacaccgtacccaagaaccctacgttcctacccgtagaacctagttagtagtttaanacgtcgaacccgccgacgaacgtaccgaccggtaccgttgttaacttacgtggtacgacgtaaggagtacggttacccgttttaagtttaacggacctaagttacgtttaaacgttaaaaccttccgttaacgttacggtcgtacggtaacgttcggcggggacgaacggggaaccgtaacgg

SEQ ID NO: 411014 - DNA, 744 bp, Homo sapiens
  misc_feature: GZ8MTXP01BDYF0.9.70.G04.1.454.CMB.2.raw
  modified_base (236)..(236): a, c, t, g, unknown or other
  modified_base (382)..(382): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggcccctgtcccctcacctgcactgtctctggtnactccatcgaggtaggttcggtccttcctacgtggaccttgggactcccgggctacggtcccggccgggtacgaaaggggtcctagggaacgttaatacgtttgggaaaccgtaattcgtagtcggcccgtagggtccgggacccncctatacccgtaacctaaccccccccgttccacgaaaggtcgtacccgaaagttccaaggctaacgttcggtaccaacggttcccgaaaccgtaacccggttaccccaaacggtaaaaccccgttacgtttcccctaccccgttaaggaaccgtaggttacgtaaacgtttaacgtaacgttccgggaacccgcccggacgaacggaacccggtaccgggtcccgttagttaaaccttcgtcggagtacggaggtaacggtacggttaccgtttaagtttacggaactggttactaaacgttaaaaccttcgttaacgttaccggtcgtggtaactcgtggttacggcggaacgggtaaccg

SEQ ID NO: 411015 - DNA, 605 bp, Homo sapiens
  misc_feature: GZ8MTXP01CQN56.9.70.G04.1.454.CMB.2.raw
  modified_base (342)..(342): a, c, t, g, unknown or other
  modified_base (384)..(384): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcaggaggtggtcgttcctacgtggacctggactccggcacggtcccgccggcaaaggggctggagtatagttggaacgaatctatgacccaggtcgggaccncatcctaaccaaccccccgtcctagaagtacgtcgaagtccngctaatggtcagtcacaccgtcccagaaccacgttctccctgacagtgacgttatacgtacgacccgccgcgacgtaccgacgggtccgtaggtacttacgtgtacggacgtaggaggtaggtccgtttaagtttacggactagttacttaacgttaaaacttccgttacgttacggtcgtaggtcggtcggtcggggaccgtaacggggaaccgtaacgg

SEQ ID NO: 411016 - DNA, 557 bp, Homo sapiens
  misc_feature: GZ8MTXP01D599R.9.70.G04.1.454.CMB.2.raw
  modified_base (234)..(234): a, c, t, g, unknown or other
  modified_base (284)..(284): a, c, t, g, unknown or other
  modified_base (326)..(326): a, c, t, g, unknown or other
  modified_base (428)..(428): a, c, t, g, unknown or other
  modified_base (547)..(547): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtccctcacctgcactgtctctggtnactccatcagaggtgtcgttcatggacctggatccggcaggtccgccggnaagggctggatatattggacgaatctatgccaggtgggaccncctatccgtaaccaaccccccgtccctacgaaagacgtcaaagttcaagcatgtcagtcgactaccgtcccagaaccagttctcccctagacagtgagttanatgaccgcgcgaagaccgacggccgtgtacttacgtgtgcgtagagtacgtcgttaatttaggaccagttcgtagtaaaacttccgttacttacgtctggaacgtcgtggttcgtccgngggtaacccg

SEQ ID NO: 411017 - DNA, 591 bp, Homo sapiens
  misc_feature: GZ8MTXP01D0M09.9.70.G04.1.454.CMB.2.raw
  modified_base (233)..(233): a, c, t, g, unknown or other
  modified_base (269)..(269): a, c, t, g, unknown or other
  modified_base (322)..(322): a, c, t, g, unknown or other
  modified_base (363)..(363): a, c, t, g, unknown or other
  modified_base (428)..(428): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactcatcagaggtgtcttcagtgacctggatccggnagtccgcggcaagggactggatatagtggactaatctatgccaggtcggaccncatcctaaccaaccccccgtcctagaagtcgtcgaaagtcngctatcggtacacgtcgaacaccgtaccacgaacctacgtcctccgtagacgtagtagtagttanactcgaccgccgacgaacgacgacggtaccgtagttaacttacgtggtggaccgaggtagtacgggttctttaagtttacggacctaggttacttaaacgttaaaccttcgttacgttacggttctggaacgttcgtacgttcggaaccgaacggggtaaccg

SEQ ID NO: 411018 - DNA, 620 bp, Homo sapiens
  misc_feature: GZ8MTXP01C9FMY.9.70.G04.1.454.CMB.2.raw
  modified_base (235)..(235): a, c, t, g, unknown or other
  modified_base (265)..(265): a, c, t, g, unknown or other
  modified_base (272)..(272): a, c, t, g, unknown or other
  modified_base (285)..(285): a, c, t, g, unknown or other
  modified_base (316)..(316): a, c, t, g, unknown or other
  modified_base (583)..(583): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtcccctcacctgcactgtctctggtnactccatcagaggtgtcgttcatcgcgcgngcgtcgngcgccgcgagagnagatatgagatatctgcgcgaggtacggccncactaccaacccccacccgtccagaagtcgaacgagtcagctaagttcgacacgtaccgaacctccgtaaccgaactaaccttcgttccctaccgagtacgtagtagtaacttacgcgacccgccccgacggaacgaaccggacggacccggttgttaagttacctggttacggcggaaggtaacgggtcggtaaacggttttccgtttaaagttacccggaacttaggttaaacttaaacgttaaacccttcgttacgttaacggngtcgggtacgttcgggacgggtaacgaaccgggtaac

SEQ ID NO: 411019 - DNA, 589 bp, Homo sapiens
  misc_feature: GZ8MTXP01A2DDB.9.70.G04.1.454.CMB.2.raw
  modified_base (238)..(238): a, c, t, g, unknown or other
  modified_base (268)..(268): a, c, t, g, unknown or other
  modified_base (274)..(274): a, c, t, g, unknown or other
  modified_base (285)..(286): a, c, t, g, unknown or other
  modified_base (290)..(290): a, c, t, g, unknown or other
  modified_base (297)..(297): a, c, t, g, unknown or other
  modified_base (300)..(301): a, c, t, g, unknown or other
  modified_base (357)..(357): a, c, t, g, unknown or other
  modified_base (397)..(397): a, c, t, g, unknown or other
  modified_base (471)..(471): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggcccaggactagtgaagccttcacgacggcccctgtcccctcacctgcactgtctctggtnactccatcaggaggtgtcttcatcgcgcgngcgcgncgcgcgagagnngatntagtganatnncgcgaggtcgaccactactaccaacccccgaccctcaagaagtcgtaacgatcacntagctacgcgaccaccacctacgaactaacgttcgtcccncgaagactagtagttaatctaacgccgacccgcgtaacgaaccggtaccgtccgggttacttgttaacttcggngtacccggagtacgtaggtccgttaactttaagttacgacttacgttaacgtaaaacgttaaccttcgttacggtaacgtgaacgggttccggagggccggtaacgaaccgggtaacc

SEQ ID NO: 411020 - DNA, 599 bp, Homo sapiens
  misc_feature: GZ8MTXP01EYJLW.9.70.G04.1.454.CMB.2.raw
  modified_base (231)..(231): a, c, t, g, unknown or other
  modified_base (250)..(250): a, c, t, g, unknown or other
  modified_base (265)..(265): a, c, t, g, unknown or other
  modified_base (314)..(314): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctccagatgggtcctgtcccaggtgcggctgcaggagtcggcccaggactagtgaagccttcacaggccctgtccctcacctgcactgtctctggtnactcatcagagtgtctcanggactggactccggnagtccgcgacaaggctggatatatggacatcatgccaggtcgggacccncactaccaccacccccgtccagaagtcgtcgaagtcaagtctaagtcgacacgtaccgaactaccgtacccaacgaacctacgttcctcccgtagtaacgtagttagtaacgttactacgtacgacccgaccgacggaacgaccgaccggtacgtattacgttacgtgtagcgtagacgtacggttacgtttaagtttacggactacgttacgttaaacgttaaacttcgttacgttacgtcgtacggtaacgtcggtacgggaccgtaacgggttaaccgaacg

SEQ ID NO: 411021 - DNA, 553 bp, Homo sapiens
  misc_feature: GZ8MTXP02HBP9C.9.70.G04.1.454.CMB.2.raw
  modified_base (331)..(331): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaaggggactgggagtatattggacgaatctatgccaggtggaccncatcctacaaccccccgtccacaagagtcgagtcagcatgtcagtcgacacgtcccagaaccagttctccctgacagtgagttatatgaccgccgcagacacggccgtgtatacgtgtgcgagtagacggtccgtttaagtttacggaccagtacttacgttaaaaacctaccgtactacggtcgtacggacgtcgtacggggaccgacggggaccgaacgg

SEQ ID NO: 411022 - DNA, 558 bp, Homo sapiens
  misc_feature: GZ8MTXP02IPCSH.9.70.G04.1.454.CMB.2.raw
tcagtgatacgtctcacgaccggtgctcgatttagtgtagtgtgaagggaaagggcctgtgaagccttcacaggccctgtccctcacctgcactgtctctggtgactccatcagaggtggtcgttcctactggacctggatccggcagtccgccggcaagggactggagtatattggacgaatctatgccagtggaccgccatctacaacccgtcctcaagagtcgagtcagcatgtcagtcgacacgtcccagaaccagttctccctgacagtgagttatatgaccgccgcagacacggccgtgtattactgtgcgagagagccgttatttagaccagcctagtaaaaactctaactacgtctgcgtcgtggggccgaggggaccaaggcaccgtctcctcacgcctccaccgaacgggcccacgtccggtcccttcccccgtggccgcccctgccttaccgaggacgccaccgtccgacgacgcaccgagccgcccgtcgggctcggcctggtcaacggcctaacttccgaagacgtactcaactcgacgcggacg

SEQ ID NO: 411023 - DNA, 513 bp, Homo sapiens
  misc_feature: GZ8MTXP02GTWI6.9.70.G04.1.454.CMB.2.raw
  modified_base (199)..(199): a, c, t, g, unknown or other
  modified_base (312)..(312): a, c, t, g, unknown or other
  modified_base (400)..(400): a, c, t, g, unknown or other
  modified_base (430)..(430): a, c, t, g, unknown or other
  modified_base (433)..(433): a, c, t, g, unknown or other
  modified_base (436)..(436): a, c, t, g, unknown or other
tcagtgatacgtctcacgaccggtgctcgatttagtgtagtgtgaagggaaagggcctgtgaagccttcacaggccctgtccctcacctgcactgtctctggtgactccatcagaggtggtcgttcctactggacctggatccggcagtccgccggcaagggactggagtatattggacgaatctatgccagtggaccnccatctacaacccgtcctcaagagtcgagtcagcatgtcagtcgacacgtcccagaaccagttctccctgacagtgagttatatgaccgccgcagacacggccgtgtattacngtgcgagagaggccgttatttaggaccagcctagtaaaactctactacgtctggcgtcgtggggccaggggaccaagggtcaccgtcnctcagcctcacaaggcccatcggctccccngcnccngctccagcgcacctccgagcgcacagcgccctgggctgctggcaagactacttccaagacgtatcactgacgcggcg

SEQ ID NO: 411024 - DNA, 587 bp, Homo sapiens
  misc_feature: GZ8MTXP02F02ZD.9.70.G04.1.454.CMB.2.raw
  modified_base (234)..(234): a, c, t, g, unknown or other
  modified_base (336)..(336): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtccctcacctgcactgtctctggtnactccatcagaggtggtcgttcctactggacctggatccgggcaggtcccgccggcaaggggactgggagtatagttggacgaatctatgccagtgggaccncatcctacaaccccccgtcctacaagacgtcgagtcagcatgtcagtcgacaccgtcccagaaccagttcctccctgacagtagagttatatcgaccgccgacacgacgacggccgtagtacttacgtgtcgacgagagacggtaccgtttagtttacggacctagtacttaacggttaaaaacctccgtaacgttacggtcgttacggtaaccggtcggtcgggggaccgaacgggggaccgtaaacggg

SEQ ID NO: 411025 - DNA, 541 bp, Homo sapiens
  misc_feature: GZ8MTXP02FQVSW.9.70.G04.1.454.CMB.2.raw
  modified_base (326)..(326): a, c, t, g, unknown or other
  modified_base (350)..(350): a, c, t, g, unknown or other
  modified_base (359)..(359): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctatggacctggatccggcagtccgccggcaagggactggatatattggacaatctatgccagtgggaccncatctacaacccccgtcctcaagngtcgagtcngcatgtcagtcgacacgtcccagaacccagttctccctgacagtcgagttatatcgaccgccgcacgacgacggccgtgtacttacgtgtgcgagagaggtccgttagtttacggaccagtcttaacgttaaaactcctactacggtcgtacggacgtcgtcgggccgacggggactaacgg

SEQ ID NO: 411026 - DNA, 555 bp, Homo sapiens
  misc_feature: GZ8MTXP02GGLDB.9.70.G04.1.454.CMB.2.raw
  modified_base (444)..(444): a, c, t, g, unknown or other
  modified_base (451)..(451): a, c, t, g, unknown or other
  modified_base (467)..(467): a, c, t, g, unknown or other
tcagtgatacgtctcacgaccggtgctcgatttagtgtagtgtgaagggaaagggcctgtgaagccttcacaggccctgtccctcacctgcactgtctctggtgactccatcagaggtggtcgttcctactggacctggatccggcagtccgccggcaagggactggagtatattggacgaatctatgccagtggaccgccatctacaacccgtcctcaagagtcgagtcagcatgtcagtcgacacgtcccagaaccagttctccctgacagtgagttatatgaccgccgcagacacggccgtgtattactgtgcgagagaggccgttattttaggaccagcctgttaaaaaactctaactacggtctggacgtctgggggccagggggaccaaaggtcaccgtctcctcagcctccaccaagggcccatcgtcttcccccgngccgccncgctcacgacgcaccnccgacgacgcacacgcgccgtcggcgcgccgtcggtacgaacgaacgtaccttaccgtaacgacgtaactacacgtacgacggcggcg

SEQ ID NO: 411027 - DNA, 546 bp, Homo sapiens
  misc_feature: GZ8MTXP02JUZ92.9.70.G04.1.454.CMB.2.raw
  modified_base (199)..(199): a, c, t, g, unknown or other
  modified_base (532)..(532): a, c, t, g, unknown or other
tcagtgatacgtctcacgaccggtgctcgatttagtgtagtgtgaagggaaagggcctgtgaagccttcacaggccctgtccctcacctgcactgtctctggtgactccatcagaggtggtcgttcctactggacctggatccggcagtccgccggcaagggactggagtatattggacgaatctatgccagtggaccnccatctacaacccgtcctcaagagtcgagtcagcatgtcagtcgacacgtcccagaaccagttctccctgacagtgagttatatgaccgccgcagacacggccgtgtattactgtgcgagagaggccgttatttaggaccagcctagtaaaaactctactacggtctggacgtctggggccagggggaccaaggtcacccgtctccgtcacgcctccacccgaaagggcccaatccggtccttcccccgtggccgcccctgcctccgacggagcaccgccgagacgcacagcgccctgggctgcctggcaaggctacttccaagaccgtaacncactcgacgcggcg

SEQ ID NO: 411028 - DNA, 534 bp, Homo sapiens
  misc_feature: GZ8MTXP02J0GRI.9.70.G04.1.454.CMB.2.raw
  modified_base (234)..(234): a, c, t, g, unknown or other
  modified_base (356)..(356): a, c, t, g, unknown or other
  modified_base (365)..(365): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtccctcacctgcactgtctctggtnactccatcagaggtggtcgtcctactggacctggatccggcagtccgccggcaaggggactggagtatagttggacgaatctatgccagtgggaccgcatctacaaccccccgtcctcaagngtcgagtcngcatgtcagtcgacacgtcccagaaccagttctccctgacacgtgtagttatagtcgaccgccgcacgacacggccgtgtattacgtgtgcgagagagtcgttagtttaggaccagtctacgttaaaactcctacgtacgtcgtggacgtcgtgtcggacgagggaccg

SEQ ID NO: 411029 - DNA, 578 bp, Homo sapiens
  misc_feature: GZ8MTXP02I48F0.9.70.G04.1.454.CMB.2.raw
  modified_base (334)..(334): a, c, t, g, unknown or other
  modified_base (356)..(356): a, c, t, g, unknown or other
  modified_base (368)..(368): a, c, t, g, unknown or other
  modified_base (410)..(410): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtcccctcacctgcactgtctctggtgactccatcagaggtggtcgttcctactggacctggactccggcacgtcccgccggcaagggactggatatagttggacaatctatgccagtcgggaccncatctacaaccccccgtcctanaagcgtcgatcngcatgtcagtcacacgtcccaagaacctagtcctccctgacngtgtagttatagtcgaccgcgacacgacgacggtccgtagtacttacgtgtcgacgagacgacgtaccgtttagtttacggacctaggtaccttaacgttaaaacctccgttaacgtacggtcgtacggtaccggttcggacgggaccgtaacggggaacctaaccgg

SEQ ID NO: 411030 - DNA, 541 bp, Homo sapiens
  misc_feature: GZ8MTXP02HA8OZ.9.70.G04.1.454.CMB.2.raw
  modified_base (233)..(233): a, c, t, g, unknown or other
  modified_base (325)..(325): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtgtcgttcctactggacctggactccggcagtccgccggcaagggctggatatatggactaatctatgccagtggaccncatctacaacccccgtcctacaagagtcgagtcagcatgtcagtcgacacgtcccagaaccagtctcctgacagtgtagttatatcgaccgccgacacgacgacggcgtagtacttacgtgtcgcgagagagtccgttagtttacgactacgtactaacgttaaaactcctaacgtacggtcgtacggtacgtcgtgtcggaccgtacgggaaccg

SEQ ID NO: 411031 - DNA, 542 bp, Homo sapiens
  misc_feature: GZ8MTXP02INJKB.9.70.G04.1.454.CMB.2.raw
  modified_base (353)..(353): a, c, t, g, unknown or other
  modified_base (366)..(366): a, c, t, g, unknown or other
  modified_base (381)..(381): a, c, t, g, unknown or other
  modified_base (398)..(398): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtcccctcacctgcactgtctctggtgactccatcagaggtgtcgttcctactggacctggatccggcagtcccgccggcaaggggactggatatattggacgaatctatgccagtggaccgccatctaccaacccccgtccctnaagagtcgagtcngcatgtcagtcgacncgtcccagacccagtcnccctgacagtgagttatatgaccgccgcagacacggccgtagtatactgtgcgagagagtccgtttagtttacggacctacggtactacgttaaaactccttaactacggtcgtcggacgttctagtcggccgaggggtaaccg

SEQ ID NO: 411032 - DNA, 599 bp, Homo sapiens
  misc_feature: GZ8MTXP02HDUV5.9.70.G04.1.454.CMB.2.raw
  modified_base (332)..(332): a, c, t, g, unknown or other
  modified_base (356)..(356): a, c, t, g, unknown or other
  modified_base (360)..(360): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtcccctcacctgcactgtctctggtgactccatcagaggtggtcgttcctactggacctggatccggcagtcccgccggcaaggggctggatatagtggacgaatctatgccagtcgggaccncatctaaccaaccccccgtcctanaagngtcgagtcagcatgtcagtcacacgtccagaccagtcctccgtagactagtagtagttatacgtcgaccgcgacacgacgacggtccgtagtacttactgtcgcgagaggtacgtccgtttaagtttacggacctagtacgttaaacgttaaaaaccttcccttaaacgttaccgggtaacgtacgggtaccggttaccggtacgggggacccggaacgggggtaacccgtaaaccggg

SEQ ID NO: 411033 - DNA, 539 bp, Homo sapiens
  misc_feature: GZ8MTXP02G94A8.9.70.G04.1.454.CMB.2.raw
  modified_base (330)..(330): a, c, t, g, unknown or other
  modified_base (397)..(397): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtccctcacctgcactgtctctggtgactccatcagaggtggtcgttcctactggacctggatccggcagtccgccggcaagggactggagtatattggacgaatctatgccagtgggaccncatcctacaacccccgtcctcaagagtcgagtcagcatgcagtcgacacgtccagaccagtctcccngacagtgacgttatatgaccgccgacagacacggccgtgtacttacgtgtgcgagagaggtaccgtttagtttacggactagtctaagttaaaactcctaacgtacggtcgtcggacgtcgtgggaccgacgggactaacgg

SEQ ID NO: 411034 - DNA, 538 bp, Homo sapiens
  misc_feature: GZ8MTXP02IE4F2.9.70.G04.1.454.CMB.2.raw
  modified_base (233)..(233): a, c, t, g, unknown or other
  modified_base (326)..(326): a, c, t, g, unknown or other
  modified_base (345)..(345): a, c, t, g, unknown or other
  modified_base (349)..(349): a, c, t, g, unknown or other
  modified_base (358)..(358): a, c, t, g, unknown or other
  modified_base (373)..(373): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtgtcgttcctatggacctggatccggcagtcccgccggcaagggactggagtatattggacgaatctatgcagtggaccncatctacacccccgtcctnaagngtcgagtcngcatgtcagtcgacnccgtcccagaaccagttctccctgacagtgagttatatgaccgccgcagacgacggccgtgtacttacgtgtgcgagagtaggtacgtttagtttaggacctagtacttaacgttaaaacctctactacggtctaggacgtcgtcggggccgagggacctaacgg

SEQ ID NO: 411035 - DNA, 552 bp, Homo sapiens
  misc_feature: GZ8MTXP02I66L2.9.70.G04.1.454.CMB.2.raw
  modified_base (235)..(235): a, c, t, g, unknown or other
  modified_base (329)..(329): a, c, t, g, unknown or other
  modified_base (347)..(347): a, c, t, g, unknown or other
  modified_base (351)..(351): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtcccctcacctgcactgtctctggtnactccatcagaggtgtcgttcctactggacctggatccggcagtccgccggcaaggggctggatatattggacgaatctatgccagtggacccncatctacaccccgtccanaagngtcgagtcagcatcgtcagtcacaccgtaccacgaacctacgtcctaccctgacagtagtagttatacgtacgaccgccgacgacgacgaccggtcgtagtacttacgtgtcgacgagagacgtacgtttacgttacgactacgtactaacgtaaactcctacgtacgtcgtggtacgtcgacgggacgacgggacgtacg

SEQ ID NO: 411036 - DNA, 555 bp, Homo sapiens
  misc_feature: GZ8MTXP02H2806.9.70.G04.1.454.CMB.2.raw
  modified_base (233)..(233): a, c, t, g, unknown or other
  modified_base (329)..(329): a, c, t, g, unknown or other
  modified_base (350)..(350): a, c, t, g, unknown or other
  modified_base (354)..(354): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtggtcgttcctactggacctggatccggcagtccgccggcaaggggctggatatagtggacgaatctatgccaggtcggaccnccatctacacccccgtcctanaagngtcgagtcagcatcgtcagtcacacgtcccagaccagtctcctgacagtgagttatatcgaccgccgcacgacgacggcgtagtatacgtgtcgcgagagtacggtccgtttagtttacggacgtacgtacgttaaacgttaaaacctccttaacgtacggttcgtacggtacgtcgtgtacggaccgtaacggggaaccg

SEQ ID NO: 411037 - DNA, 579 bp, Homo sapiens
  misc_feature: GZ8MTXP02JZMNL.9.70.G04.1.454.CMB.2.raw
  modified_base (376)..(376): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtccctcacctgcactgtctctggtgactccatcagaggtggtcgttcctactggaccctggatccggcacgtcccgccggcaaggggctggagtatattggacgaatctatgccaggtcgggacccgccatcctaaccaaccccccgtccctacaagagtcgagtcngcatgtcagtcaccaccgtcccagaacccagttcctccctgacagtgtagttatagtcgaccgccgacacgaccgaccgggtccgtagtattacgtgtgcgaggagacggtaccgtttagtttacggacctacgtacttaacgttaaaacctcctaacgtacggtcgtacggacgtcggtcggggccgacggggacctaacgg

SEQ ID NO: 411038 - DNA, 576 bp, Homo sapiens
  misc_feature: GZ8MTXP02G2J97.9.70.G04.1.454.CMB.2.raw
  modified_base (200)..(200): a, c, t, g, unknown or other
  modified_base (220)..(220): a, c, t, g, unknown or other
  modified_base (451)..(451): a, c, t, g, unknown or other
  modified_base (472)..(472): a, c, t, g, unknown or other
tcagtgatacgtctcacgaccggtgctcgatttagtgtagtgtgaagggaaagggcctgtgaagccttcacaggccctgtccctcacctgcactgtctctggtgactccatcagaggtggtcgttcctactggacctggatccggcagtccgccggcaagggactggagtatattggacgaatctatgccagtgggaccnccatctacaacccgtccctnaagagtcgagtcagcatgtcagtcgacacgtcccagaaccagttctccctgacagtgagttatatgaccgccgcagacacggccgtgtattactgtgcgagagaggtccgttatttaggaccagcctagttaaaaactcctaactacggtctggcgtctggggccaggggaccaagggtcaccggtctcctcacgcctccaccgacgggccccagtccgtccttcccccgnggccgccctgctccagggacnccaccgtccgagacgcaccagcggcccgtgggcctggcccgtgggtaccaaacgggtaccttaccgttaccgaaggtacggtactcacggtcgacggcgggcgg

SEQ ID NO: 411039 - DNA, 537 bp, Homo sapiens
  misc_feature: GZ8MTXP02FYHQY.9.70.G04.1.454.CMB.2.raw
  modified_base (233)..(233): a, c, t, g, unknown or other
  modified_base (326)..(326): a, c, t, g, unknown or other
  modified_base (345)..(345): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtggtcgttcctactggacctggatccggcagtccgccggcaagggctggatatatggacgaatctatgccagtgggaccncatctacaacccccgtccncaagagtcgagtcagcatgtcagtcgacacgtcccagaaccagtctcctgacagtgagttatatcgaccgccgacacgacgacggccgtagtacttactgtgcgagagaggtccgttagtttacggactagtactaagttaaaacctctaactacgtcgtacggacgtcgtgggaccgacggggactaacgg

SEQ ID NO: 411040 - DNA, 554 bp, Homo sapiens
  misc_feature: GZ8MTXP02H7YLI.9.70.G04.1.454.CMB.2.raw
  modified_base (322)..(322): a, c, t, g, unknown or other
  modified_base (348)..(348): a, c, t, g, unknown or other
  modified_base (394)..(394): a, c, t, g, unknown or other
  modified_base (449)..(449): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctccagatgggtcctgtcccaggtgcggctgcaggagtcgggcccaggactagtgaagccttcacaggccctgtccctcacctgcactgtctctggtgactcatcagaggtgtcgtcactggacctggatccggcagtccgcggcaagggactggagtatatggacaatctatgccaggtgggacccncatcctaaccaaccccccgtccctanaaagagtcgagtcagcatgtcagtcgacaccgaccagaacagttcnccctgacagtgtaagttatactcgaccgccgacagacacggccgtagtattacgngtgcgagagaggtaccgtttagtttacggacacgtactaaacgttaaaaacctcctaacgtacggtcgtaggaccgtcggacggggaccgacggggaaccaacgg

SEQ ID NO: 411041 - DNA, 545 bp, Homo sapiens
  misc_feature: GZ8MTXP02IFFZO.9.70.G04.1.454.CMB.2.raw
  modified_base (233)..(233): a, c, t, g, unknown or other
  modified_base (311)..(311): a, c, t, g, unknown or other
  modified_base (315)..(315): a, c, t, g, unknown or other
  modified_base (323)..(323): a, c, t, g, unknown or other
  modified_base (344)..(344): a, c, t, g, unknown or other
  modified_base (348)..(348): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtgtcttcctactggacctggatccggcagtccgccggcaaggctggagtatatggacgaatctangccngtggaccncatctacaacccccgtcctanaagngtcgagtcagcaatgtcagtcgactaccgtcccagaacccagtcctcctcgacagtgtaacgttatatcgaccgccgcagacacggcgtgtatacgtgtgcgagagagtaccgtttagtttacggacctatacgtaacgttaaaacctccttaacgtacggtcgtacggacgttcgtgtcggacgtacggggaaccg

SEQ ID NO: 411042 - DNA, 542 bp, Homo sapiens
  misc_feature: GZ8MTXP02IBSU6.9.70.G04.1.454.CMB.2.raw
  modified_base (285)..(285): a, c, t, g, unknown or other
  modified_base (326)..(326): a, c, t, g, unknown or other
  modified_base (349)..(349): a, c, t, g, unknown or other
  modified_base (353)..(353): a, c, t, g, unknown or other
  modified_base (409)..(409): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctatggacctggatccggcagtccgccggnaagggctggagtatatggacgaatctatgccagtgggaccnccatctacaacccccgtccctanaagngtcgagtcagcatcgtacagtcgacaccgtacccagaacctagttcctccctgacngtgagttatatgacccgcgacagacaccggcgtagtatactgtgcgagagacggtacctttagtttaggaccagtcttaagttaaaactcctaactacggtcgtggacgttctaggtcggcgtacgggaaccg

SEQ ID NO: 411043 - DNA, 596 bp, Homo sapiens
  misc_feature: GZ8MTXP02JV9CY.9.70.G04.1.454.CMB.2.raw
  modified_base (234)..(234): a, c, t, g, unknown or other
  modified_base (332)..(332): a, c, t, g, unknown or other
  modified_base (356)..(356): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtccctcacctgcactgtctctggtnactcatcagaggtgtcgttcctatggacctggatcccggcaggtcccgccggcaaaggggctggatatagtggacaatctatgcccaggtgggacccncatcctaaccaaccccccgtccanaagcgtcgatcagcatgtacagtccgaaccacccgtacccaacgtaaccctacgttccctcccgtagacgagtagtaagttatacgtacgacccgccgacgacgaccgacggtccgtagttacttacgtgtcgcgagaggtacggtacgtttaacgttacggactacgtacttaaacgttaaaacctaccgtaacgtacggtcgtacggtacgtcggtcgggaccgacgggaccgtacgg

SEQ ID NO: 411044 - DNA, 574 bp, Homo sapiens
  misc_feature: GZ8MTXP02HUA5M.9.70.G04.1.454.CMB.2.raw
  modified_base (234)..(234): a, c, t, g, unknown or other
  modified_base (333)..(333): a, c, t, g, unknown or other
  modified_base (353)..(353): a, c, t, g, unknown or other
  modified_base (380)..(380): a, c, t, g, unknown or other
  modified_base (426)..(426): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtcccctcacctgcactgtctctggtnactccatcagaggtgtcttcctactggacctggactccggcagtcccgccggcaaagggctggatatagttggaacaatctatgaccaggtcgggaccncatcaccacccccgtcctanaagagtcgagtcagcatgtcagtcacncgtccagaccagtctccctgacagtagagttatatcgaccgccganacgaccgacggtccgtagtaattacgtggtcgacgtagagtacggttccgtttaagtttacggacctagtacgttaaacgttaaaacctcctaacgttacggtaacgtcggacgttcggtacgggaccgaacggggtaccgtaaacgg

SEQ ID NO: 411045 - DNA, 564 bp, Homo sapiens
  misc_feature: GZ8MTXP02F2G2Z.9.70.G04.1.454.CMB.2.raw
  modified_base (233)..(233): a, c, t, g, unknown or other
  modified_base (327)..(327): a, c, t, g, unknown or other
  modified_base (345)..(345): a, c, t, g, unknown or other
  modified_base (420)..(420): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtggtcttcctatggacctggatccggcagtcccgccggcaagggctggatatattggaacaatctatgccagtcgggaccncatctacacccccgtccngagtcgtcgatcagcagtcgacagtcgacaccgtacccagaacctacgttcctccgtagactagtacgtagttanactcgacccgcgacacgacgacggtccgtagtacgttacgtgtcgagagacgtacggtacgtttagttacggactacgtactaaacgttaaaacctccgtaacgtacgtcgtacggtacgtcgtggtacggacggacggtaacg

SEQ ID NO: 411046 - DNA, 659 bp, Homo sapiens
  misc_feature: GZ8MTXP02JK125.9.70.G04.1.454.CMB.2.raw
  modified_base (351)..(351): a, c, t, g, unknown or other
  modified_base (502)..(502): a, c, t, g, unknown or other
  modified_base (535)..(535): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggcccctgtcccctcacctgcactgtctctggtgactccatcaggtaggtggtccgttacctacgtggacctgggactccgggcacggtcccgccggacaaggggctggaagtatagtaggacaatctaagcgccgaggtcgggacccnctactacctaaccgaaccccccgtcctacgaaagacgtcgagtcagctaacgtcgtaccacgtccgaaacctacccggtacccaagaaaccctacgttccctaccctaggacctaggtagtaagtttactacgtaccggacccggcccganaacggaccgtaccgggtccgttagtacttacgnggtacgacggagtaggtcggtacgtttaacgttacggacctaggtacttaaacgtttaaaacctcgttaacgtcggtcgtacggtacggtccggtaggggtaccgaacggggtaaccgtaacgg

SEQ ID NO: 411047 - DNA, 568 bp, Homo sapiens
  misc_feature: GZ8MTXP02HYUZY.9.70.G04.1.454.CMB.2.raw
  modified_base (411)..(411): a, c, t, g, unknown or other
  modified_base (461)..(461): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggactccggcagtccgccggcaagggactggagtatagtggaacgtaatctatgcccagtcggaccgccatcaaccaaccccccgtcctacaagacgtcgagtcagctaatgtacagtccacaccgtcccagacccagtcctcccngacagtgagttatactagaccgccgacacgacacggccgtgtacttacgngtagcgtaggagacggtaccgtttatttacgggacctacgtacttaacttaaaaccgtcctaactacggtcgtaggtacgtcgtacgggccgaagggtaccgaacgg

SEQ ID NO: 411048 - DNA, 556 bp, Homo sapiens
  misc_feature: GZ8MTXP02IPGUA.9.70.G04.1.454.CMB.2.raw
  modified_base (235)..(235): a, c, t, g, unknown or other
  modified_base (276)..(276): a, c, t, g, unknown or other
  modified_base (415)..(415): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtcccctcacctgcactgtctctggtnactccatcagaggtggtcgttcctatggacctggatccggnacgtccgccggcaagggctggagtatatggacgaatctatgccaggtggaccgcatctaccaacccccgtccctacaagcgtcgagtcagcatgtcagtcgacacgtcccagaaccagttctccctgacagtgagttanatgaccgcgcgacgacaccgggccgttagtagttaccgtgtgcgagagacggtcccgttttaagtttacgggacctagtaccgttaagttaaaaacctctaacgtacggtctggacgtcgtgggaccacggggactaacgg

SEQ ID NO: 411049 - DNA, 681 bp, Homo sapiens
  misc_feature: GZ8MTXP02JSIZA.9.70.G04.1.454.CMB.2.raw
  modified_base (235)..(235): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagcctcccagatgggtcctgtcccaggtgcggctgcaggagtcgggcccaggactagtgaagccttcacaggccctgtcccctcacctgcactgtctctggtnactccatcagtaggtgttcttcctactcggacctggactccggcacggtcccgccggacgaaggggacctgggactatagttggaacgtaatctagtcggacccaaggttcgggaccctaccattccctaaaccaaccccccgtccctacgaaacgacggttacgacgtcagcctagtcgtaccgacgtacccgaaccgtaccggtaccccaaacggtaaaccctacgtttaccctcccgttacgaaacctaggttacggtaaactttacgttaacgtccggaacccgcccgacgacgaaccgtacgggtacccgttagtactttaccgtggacgacggtaagacggacggttaccgtttattacgggaccaagtacgtaaagttaaaccctaccgtacgtacgtcgtcggacggttcggcggggaccgacggggtaactaaccgg

SEQ ID NO: 411050 - DNA, 614 bp, Homo sapiens
  misc_feature: GZ8MTXP02HL5EI.9.70.G04.1.454.CMB.2.raw
  modified_base (234)..(234): a, c, t, g, unknown or other
  modified_base (245)..(245): a, c, t, g, unknown or other
  modified_base (342)..(342): a, c, t, g, unknown or other
  modified_base (399)..(399): a, c, t, g, unknown or other
  modified_base (415)..(415): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtccctcacctgcactgtctctggtnactccatcagnggtgtcgttcctactggacctggactccgggcacggtccgccggcgaagggactggatatagttggaacgtaatctaagtcgccaggtcgggacccnccatcctaaccaacccccccgtcctacgaagacgtcgagtcagcatgtcagtcgacnctccagacctagtccncccgtgactagtgtacgttatactcgaccgccgacacgaccgaccggtacgttagttacgttacgtggtacggcgaaggtacggtacgggtaccgttttaagtttacgggacctaggtacttaaacggttaaaaacctccgttaaacgttaccggtaacgtacgggacgttcgtaggtccggacggtacggggtaaccg

SEQ ID NO: 411051 - DNA, 555 bp, Homo sapiens
  misc_feature: GZ8MTXP02FXODT.9.70.G04.1.454.CMB.2.raw
  modified_base (234)..(234): a, c, t, g, unknown or other
  modified_base (330)..(330): a, c, t, g, unknown or other
  modified_base (354)..(354): a, c, t, g, unknown or other
  modified_base (416)..(416): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtcccctcacctgcactgtctctggtnactccatcagaggtggtcgttcctactggacctggatccggcagtccgccggcaagggactggatatattggacgaatctatgccaggtgggaccnccatcctacaacccccgtccctanaagagtcgagtcagcatgtcagtcgacacgtcccagaaccagttctcctgacagtgagttanatcgaccgccgcacgacacggcgtagtacttactgtgcgagagacggtccgtttagtttacggaccagtacttaagttaaaacctcctaacgtacggtcgtacggacgttcgtacggggaccgacggggacctaaacgg

SEQ ID NO: 411052 - DNA, 591 bp, Homo sapiens
  misc_feature: GZ8MTXP02HLBL5.9.70.G04.1.454.CMB.2.raw
  modified_base (235)..(235): a, c, t, g, unknown or other
  modified_base (336)..(336): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtcccctcacctgcactgtctctggtnactccatcagaggtgtcttcacgtggacctggactccggcacgtccgccggacgaagggctggatatagtggactaatctagtcgccgaggtcgggacccncatcctaccaaccccccgtcctagaagagtcgaagtccagctaatcgtacacgtccgaactacccgtacccaacgaaccctagtcctcccagacagtacgtaagttatacgtcgaccgccgacacgacgacggtcgtagtattacgtgtgcgagagtacgtacgtttaagttacggactacgtacgttaaacttaaaacctccttaacgtacggtcgtacggtacgtcgtacgggaccgtacgggaccgtaacgg

SEQ ID NO: 411053 - DNA, 650 bp, Homo sapiens
  misc_feature: GZ8MTXP02HW8ZR.9.70.G04.1.454.CMB.2.raw
  modified_base (214)..(214): a, c, t, g, unknown or other
  modified_base (234)..(234): a, c, t, g, unknown or other
  modified_base (276)..(276): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctccagatgggtcctgtcccaggtgcggctgcaggagtcgggcccaggactagtgaagccttcacaggccctgtcccctnacctgcactgtctcgtggtnactcatcagaggtgtcgttcctacgtggacctggactccggnacgtccgcgacgaagggctggagtaattagtaggaacgtaatctaagtcgaccgaaggtcgggaccacctatcctaaccaaccccccgtccctagaaagcgtcgaagtcagctatcggtacagtccgaactacccgtacccaacgaaaccctacgtttcccaccctagaaccgtaggtagtaagttaactacgtacgaacccgccgacgaacgtacgacgggtccgtagttaacgttacgtggtacgacggaagacggtaacggttaccgttttaagtttacggaacctaagtaccgttaaacgtaaaacccttcgtaacgtacggtcgtacggtaacgttcggacggggaccggtaacggggaacctaacggg

SEQ ID NO: 411054 - DNA, 585 bp, Homo sapiens
  misc_feature: GZ8MTXP02JQY5O.9.70.G04.1.454.CMB.2.raw
  modified_base (335)..(335): a, c, t, g, unknown or other
  modified_base (359)..(359): a, c, t, g, unknown or other
  modified_base (388)..(388): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtcccctcacctgcactgtctctggtgactccatcagaggtgtcgttcctactggacctggactccggcacgtcccgccggcaaggggactgggatatagttggacgaatctatgccaggtgggaccncatcctacaaccccccgtccctanaagacgtcgagtcagcatgtcagtcgacncgtcccagaaccacgttctccctgacagtgtagttatacgtcgaccgccgacacgaccgacgggtccgtgtacttactcggtgcgagagtaggtccgtttaacgtttacggacctacgtacgttaacgttaaaaacctccgttaacgtaccggtcgtacggtaccgttcggtcggggaccgacggggacgtaaccgg

SEQ ID NO: 411055 - DNA, 574 bp, Homo sapiens
  misc_feature: GZ8MTXP02IVZTX.9.70.G04.1.454.CMB.2.raw
  modified_base (235)..(235): a, c, t, g, unknown or other
  modified_base (338)..(338): a, c, t, g, unknown or other
  modified_base (358)..(358): a, c, t, g, unknown or other
  modified_base (362)..(362): a, c, t, g, unknown or other
  modified_base (420)..(420): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtcccctcacctgcactgtctctggtnactccatcagaggtggtcgttcctacgtggacctggactccggcacgtccgccggcaaggggactgggatatagttggacgaatctatgcccaggtcggaccncatctaccaaccccgtcccnaagngtcagtcagcatgcagtcgacaccgtaccagacctgtactccctgacagtgtagttanactgaccgcgcagacgaccgggtcgtagtacttacgtgtggcgagagacggtaccgtttaagtttacggactacgtacttaagttaaaacctccgttaacgtacggtaacgtcggtaccgttcggtacgggggaccgacgggggacctaacggg

SEQ ID NO: 411056 - DNA, 545 bp, Homo sapiens
  misc_feature: GZ8MTXP02G2LOL.9.70.G04.1.454.CMB.2.raw
  modified_base (327)..(327): a, c, t, g, unknown or other
  modified_base (355)..(355): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtcccctcacctgcactgtctctggtgactccatcagaggtgtcgtcctatggacctggatccggcagtccgccggcaagggctggatatatggacgaatctatgccaggtgggacccncatcctaacaaccccccgtcctcaaagngtcgagtcagcatgtcagtcgacaccgtcccagaaccagttctccctgacagtgagttatatcgaccgccgcagacacggccgtagtattactgtgcgagagagtccgttaatttacggaccagtactaacgttaaaaacctcctaacgtaccggtcgtcggaacgttctgtcggccgacggggaacccg

SEQ ID NO: 411057 - DNA, 680 bp, Homo sapiens
  misc_feature: GZ8MTXP02GDS0C.9.70.G04.1.454.CMB.2.raw
  modified_base (236)..(236): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggcccctgtcccctcacctgcactgtctctggtnactccatcagaggtgtcgttcctagtggacctggactccggcacgtcccgccggacgaagggctggagtatagtggactaatctagtcgccgaggtcgggacccactatacctaaccaaccccccgtcctacgaagacgtcgagtcagcctagtcgtaccagtaccgactaccgtacccgacgtaaaccctacgttcctccctagtaacctaggttagtaagtttaatacgtaccgacccggaccgacgaacggtaccgaccgggtaccggttagtaacgtttacgtgtacggtacggaggtacggtacggttaccgtttaagttttacggaaccttacggtaaccgttaaacgtttaaaaaccgttcccgttaaccgttaacgggtcgttacgggtaccggttcggtaccgggggaccggtaaacgggggtacccgtaacggg

SEQ ID NO: 411058 - DNA, 603 bp, Homo sapiens
  misc_feature: GZ8MTXP02G3IF5.9.70.G04.1.454.CMB.2.raw
  modified_base (274)..(274): a, c, t, g, unknown or other
  modified_base (330)..(330): a, c, t, g, unknown or other
  modified_base (352)..(352): a, c, t, g, unknown or other
  modified_base (356)..(356): a, c, t, g, unknown or other
  modified_base (379)..(379): a, c, t, g, unknown or other
  modified_base (399)..(399): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcttcctactggacctggatccggnagtccgccggcaagggactgggatatagttggacgaatctatgccagtcgggaccncatctacaaccccccgtcctanaagngtcgatcagcatgtcagtcgacncgtcccagaacccagttccnccctgacacggtagtaacgttataactcgaacccgccgacgacggaccgaaccgggcccgttagttaactttaccgtggtacgcggaggtaggacgtcccggtttaagtttacgggacctacggtaccttaacggttaaaaacctcctaacgttaacggtcgtacgggacgttcggtacgggaccggacggggaaccgtaacgg

SEQ ID NO: 411059 - DNA, 659 bp, Homo sapiens
  misc_feature: GZ8MTXP02IMFD2.9.70.G04.1.454.CMB.2.raw
  modified_base (214)..(214): a, c, t, g, unknown or other
  modified_base (233)..(233): a, c, t, g, unknown or other
  modified_base (266)..(266): a, c, t, g, unknown or other
  modified_base (276)..(276): a, c, t, g, unknown or other
  modified_base (296)..(296): a, c, t, g, unknown or other
  modified_base (312)..(312): a, c, t, g, unknown or other
  modified_base (331)..(331): a, c, t, g, unknown or other
  modified_base (335)..(335): a, c, t, g, unknown or other
  modified_base (343)..(343): a, c, t, g, unknown or other
  modified_base (414)..(414): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctnacctgcactgtctctggtnactccatcagagtgtcgtcatggactgatcggnacgtccgcgnaggctggatatatggacatntatgccagtcggaccncatctacacccccgtcctnaagngtcagtcngctatgtacacggtacacctaccgtacccaagaacccttacgttcctaccctgactagtacgtacgttaanacgtcgtaacccgccgaaacgaacggtacccgaccgggttaccgttacgttaaccgtttacggtggtacggaccggtaaggtacggtagggttacccctttttaagtttaacccggggacctaacggttaaaccttaaacggtttaaaaaccccttacccgtttacgttaaaccgggggttcgttacgggttaaccggttccgggttacgggggaacccgtaacgggggaacccttaaaccgggg

SEQ ID NO: 411060 - DNA, 849 bp, Homo sapiens
  misc_feature: GZ8MTXP02GUAVR.9.70.G04.1.454.CMB.2.raw
  modified_base (236)..(236): a, c, t, g, unknown or other
  modified_base (248)..(248): a, c, t, g, unknown or other
  modified_base (353)..(353): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggcccctgtcccctcacctgcactgtctctggtnactccatcaggnggtcgtcgttcctacgtggacctggactccggcacggtcccggccggacgaagggctgggatatagttaggaactaatctagtcgacccgtagggtcgggacccnctaactaccctaaaccaaaccccccccggttccctaacgaaaacgggacgttaccggaacgttacgaggtacctagttacggtacctaacgggttacccgaaacctaaccccggtaccccaaacgtaaaccccgttacgtttcccctacccgttacggtaaccgtaagggtttacggttaaacgttttaactaacgttaccggtaaacccccgggcccggtaaaccgtaaaccgggtaacccggaacccggggttacccggtttacggtttaaacgttttaacccggtgggttacggaacgggtaagggtaacgggtaacggggtttacccgtttttaaaaggttttaaccggaaaccgttaacggttaaaccgtttaaaaccggtttaaaaaaccgtaccccgtttaaaccggttaaccgggttaacgttacggggtaaaccgtttcggggtaccgggtaccgggggaacccggggttaaccggggtaaacccgg

SEQ ID NO: 411061 - DNA, 646 bp, Homo sapiens
  misc_feature: GZ8MTXP02IV539.9.70.G04.1.454.CMB.2.raw
  modified_base (233)..(233): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtgtcgttcctactggacctggatccggcagtccgccggcaagggactggatatatggaacgaatctatcgcccgaggtcgggacccgcatacctaaccaacccccccgttccctacgaaacgacgttaccgaagttccaggcctaattcggtaccaagggttcccgaaacctacccgtaccccaagtaaaccctacgttcctcccttagacctaggtgtaagtttaatacgtcgaacccgccgacacgaccgaccgggccgttagttaacttacgtggtgacgagtaacggacggttacccgtttaagttttacggacctagtaacttaacgttaaaaaccttcccgttaacgtacggtcgtcggtacgtcggtcggggaccgtacggggacctaacggg

SEQ ID NO: 411062 - DNA, 606 bp, Homo sapiens
  misc_feature: GZ8MTXP02HMLXG.9.70.G04.1.454.CMB.2.raw
  modified_base (235)..(235): a, c, t, g, unknown or other
  modified_base (246)..(246): a, c, t, g, unknown or other
  modified_base (342)..(342): a, c, t, g, unknown or other
  modified_base (366)..(366): a, c, t, g, unknown or other
  modified_base (392)..(392): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtcccctcacctgcactgtctctggtnactccatcagnggtgtcgttctacgtggacctggactccggcacggtcccggccggacgaaaggggcttgggatatagttggacgaatctagtcgcaggtcggaccncatctaccacccccgtcccagagngtcgagtcagcaatgtacagtcgacnccgtcccaagaaccctagttcctcctgactagtagtagttactagtcgaccgccgacgaacgacgaccggtccgtagtacgttacgtgtcgacggaggagtacggtaccgttttacgtttacggacctacgtacgtttaaacgttaaaaacctccgttaacgttacggtaacgtaggtaccgtcggtacggggaccgtacggggaccgtaacgg

SEQ ID NO: 411063 - DNA, 571 bp, Homo sapiens
  misc_feature: GZ8MTXP02GH1NY.9.70.G04.1.454.CMB.2.raw
  modified_base (233)..(233): a, c, t, g, unknown or other
  modified_base (244)..(244): a, c, t, g, unknown or other
  modified_base (270)..(270): a, c, t, g, unknown or other
  modified_base (325)..(325): a, c, t, g, unknown or other
  modified_base (344)..(344): a, c, t, g, unknown or other
  modified_base (367)..(367): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagnggtgtcttctatggactggatccggnagtccgcggcaagggctggatatagttggactaatctatcgccaggtcgggaccncatctacacccccgtcctnaagacgtcgagtcagcatcgtcngtcaccactcccacgaacctacgttcctcctagacagtgtaagttactatcgaccgccgcagacgacggcgtatacttcgtagtgtcggagaggtacggtacgtttaacgtttacggacctacgtacgttaaacgttaaaacctccgtaacgttacggtccgtaggtacgttcggtacggggaccggacggggacccgtaacgg

SEQ ID NO: 411064 - DNA, 620 bp, Homo sapiens
  misc_feature: GZ8MTXP02I5OUU.9.70.G04.1.454.CMB.2.raw
  modified_base (235)..(235): a, c, t, g, unknown or other
  modified_base (338)..(338): a, c, t, g, unknown or other
  modified_base (363)..(363): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtcccctcacctgcactgtctctggtnactccatcagaggtgtcgttcctactggacctggatccggcaggtcccgccggacaaggggactggatatagttggaacaatctatcgaccaggtcgggaccncatcctaccaacccccccgtcctanaagcgtcgagtcagctaagtcgtacacgtccgaacctacccgtacccaagaaaccctacgttccctaccctagaacgtaggtagtaagtttaactacgtcggacccgccgacgaacgaccgaccgggtccgttagtacttacgtggtgacgaggaggtacggtcgtttaagtttacggaactacggtacttaaacgttaaaacctccgtaacgtacggtcgtacggtactcgtaggtcggaccggacggggtaaccg

SEQ ID NO: 411065 - DNA, 587 bp, Homo sapiens
  misc_feature: GZ8MTXP02JWY8K.9.70.G04.1.454.CMB.2.raw
  modified_base (234)..(234): a, c, t, g, unknown or other
  modified_base (335)..(335): a, c, t, g, unknown or other
  modified_base (355)..(355): a, c, t, g, unknown or other
  modified_base (368)..(368): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtccctcacctgcactgtctctggtnactccatcagaggtgtcgttcctactggacctggactcccggcacgtccgccggacaaggggactggagtatagttggacgatctatcgcaggtcggaccncatctacacccccgtcctanaagagtcgatcgngcatcgtcgagtcgacaccgtcccaacgaaccctacgttcctccctagacgtacgtagtaacgttatacgtacgacccgccgacgacgaccgaccgggtccgtagttacttacgtgtcgacggagtaggacgtcgtttaagtttacggacagtacttaacgtaaaacctccgtaactacggtcgtcggtacgtcggtacgggacggacggggactacgg

SEQ ID NO: 411066 - DNA, 584 bp, Homo sapiens
  misc_feature: GZ8MTXP02HSXAL.9.70.G04.1.454.CMB.2.raw
  modified_base (334)..(334): a, c, t, g, unknown or other
  modified_base (370)..(370): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggccccaggactagtgaagccttcacaggccctgtcccctcacctgcactgtctctggtgactccatcagaggtgtcgttcctactggacctggatcccggcagtcccgccggacaaggggctggagtatattggacgaatctatgccaggtgggaccncatctaccaccccccgtcctacaagacgtcgagtcngcagtcgtcaggtccacacccgtcccaagaacccagttcctccctgactagtgagttatagtcgaccgccgcgacgacgacggccgtagtacttactgtcgacgagagacggtaccgtttagtttacggacctcgtaaaacttacgttaaaaacctccttaacgtacgttaacgtacggtaccgttcgtaggtcggtaccgtaaggggaacccg

SEQ ID NO: 411067 - DNA, 556 bp, Homo sapiens
  misc_feature: GZ8MTXP02JMKDG.9.70.G04.1.454.CMB.2.raw
  modified_base (200)..(200): a, c, t, g, unknown or other
  modified_base (218)..(218): a, c, t, g, unknown or other
  modified_base (245)..(245): a, c, t, g, unknown or other
  modified_base (263)..(263): a, c, t, g, unknown or other
  modified_base (273)..(273): a, c, t, g, unknown or other
  modified_base (279)..(279): a, c, t, g, unknown or other
  modified_base (450)..(450): a, c, t, g, unknown or other
tcagtgatacgtctcacgaccggtgctcgatttagtgtagtgtgaagggaaagggcctgtgaagccttcacaggccctgtccctcacctgcactgtctctggtgactccatcagaggtggtcgttcctactggacctggatccggcagtccgccggcaagggactggagtatattggacgaatctatgccagtgggaccncatctacaacccgtcctnaagagtcgagtcagcatgtcagtcganacgtcccagaacagttcncctgacagtnagttanatgaccgcgcagacaggccgtgtattactgtgcgagagaggcgttatttaggaccagccctagttaaaaactctaactacggtctgacgtctggggccaggggaccaaggtcaacccgtctcctcacgcctcaaccaaaggcccaatcggtctcccccgtgcgccctgccncgacgacgacaccgaccgacgacgacacgacgcgccgtcggcgtcgccgtcggtacgaacgtaccgtaactaccgtaacgtacgtactacacgtacgacgacggcg

SEQ ID NO: 411068 - DNA, 637 bp, Homo sapiens
  misc_feature: GZ8MTXP02HF9GZ.9.70.G04.1.454.CMB.2.raw
  modified_base (487)..(487): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtcccctcacctgcactgtctctggtcgactccatcagaggtggtcgttacctacgtggacctggatcccggcacgtcccgccggacgaaggggactgggatatagttggaactaatctaatcgaccgaggtcgggaccctcactcctaaccaacccccccgtcctacaaaggtacgtcgaagtcagcctatcgtcagtacgacctacccgtacccaacgaaaccctacgtttccctacccgtacgacgtagtagtaacgttatacgtacgaccgccganacgacgtaccggcgttagtacgttcgacgtggacgaaggaggtacggtaccgtttagttaaccggactaacgtacgttaaacttaaaacctccgttaacgtaacggtcgtacggtacgttcgggacgggtaccgacgggtaacgtaacgg

SEQ ID NO: 411069 - DNA, 583 bp, Homo sapiens
  misc_feature: GZ8MTXP02G1HMI.9.70.G04.1.454.CMB.2.raw
  modified_base (234)..(234): a, c, t, g, unknown or other
  modified_base (245)..(245): a, c, t, g, unknown or other
  modified_base (336)..(336): a, c, t, g, unknown or other
  modified_base (428)..(428): a, c, t, g, unknown or other
  modified_base (444)..(444): a, c, t, g, unknown or other
  modified_base (471)..(471): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtccctcacctgcactgtctctggtnactccatcagnggtggtcttcctagtggacctggactccggcacgtccgccggacaaggggctggagtatagtggaacgtaatctatgccaggtcgggaccncatccacaaccccccgtcctacaagcgtcgagtcagcagtcgtcagtcacaccgtcccaagaacctgttcctaccctgacagtgaacgttanacgtcgaccgccgtanacgacgacggtccgtagtaacttacgngtacgcggagtagacggtaccgtttagtttacggactacgtactaaacgttaaaaccgtcctaacgttacgtcgtacggaccgttcgtagtcggtaccggacgggtaacccg

SEQ ID NO: 411070 - DNA, 614 bp, Homo sapiens
  misc_feature: GZ8MTXP02F6WJW.9.70.G04.1.454.CMB.2.raw
  modified_base (234)..(234): a, c, t, g, unknown or other
  modified_base (400)..(400): a, c, t, g, unknown or other
  modified_base (416)..(416): a, c, t, g, unknown or other
  modified_base (513)..(513): a, c, t, g, unknown or other
  modified_base (566)..(566): a, c, t, g, unknown or other
  modified_base (578)..(578): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctcgtggtnacctccatcaggaggttcggttccgttcctacgtcggacctggactccgggcacggtcccggccggacgaaaggggactaggagtattagttggaacaatctagtcgaccgaggtcgggacccgccatcctaaccaaccccccgtcctacgaagacgtcgacgtcngcatgtacagtcaacnccgtacccaagaacctagtccctccctagactagtcgtagttaactacgcgaccggaccgacaacggaccgtaccggtcgttaagttactacggtgngacgagacgcggttacctttaagtacggactagtacttaaacgttaaaacccncgtaagtcggtntacgggactcgggtacgggaccgaagggacctacgg

SEQ ID NO: 411071 - DNA, 568 bp, Homo sapiens
  misc_feature: GZ8MTXP02GLDOE.9.70.G04.1.454.CMB.2.raw
  modified_base (234)..(234): a, c, t, g, unknown or other
  modified_base (288)..(288): a, c, t, g, unknown or other
  modified_base (334)..(334): a, c, t, g, unknown or other
  modified_base (411)..(411): a, c, t, g, unknown or other
  modified_base (429)..(429): a, c, t, g, unknown or other
  modified_base (464)..(464): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtccctcacctgcactgtctctggtnactccatcagaggtggtcgttcctatggacctggatccgggcagtccggccggngaagggctgggatatattggacgaatctatgcccagtcgggacccncatcctaaccaaccccccgtccctagaagagtcgaagtccagcatgtcagtcgacaccgtcccagaaaccctgttcnccctgacagtgaagttanatcgaccgccgacagaccgacggcgtagtattacngtgacgagagacggtacgtttagtttacggacctagtctaaacgttaaaactccgtaacgtacggtcgtacggtaacgtcgtgtacggccgaaggggtaacccg

SEQ ID NO: 411072 - DNA, 595 bp, Homo sapiens
  misc_feature: GZ8MTXP02F05HC.9.70.G04.1.454.CMB.2.raw
  modified_base (234)..(234): a, c, t, g, unknown or other
  modified_base (342)..(342): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtccctcacctgcactgtctctggtnactccatcagaggtggtcgttcctatggacctggactccgggcacggtcccgccggcaaggggactggagtatagtttggacgaatctatcgcccaggtcgggacccnccatcctaacaaccccccgtcctacaagagtcgagtcagcatgtcagtcgacaccgtacccagaaccagttcctccctgacagtagtacgttatatcgaacccgccgacacgacgaccggtaccgtagttacttacgtgtgacggagagtacggtaccgtttaagtttacggaacctagtacttaaacgttaaaaccttccgtaaccgtacggtcgtcggacgtcggtacgggaccgacggggaccgtaacgg

SEQ ID NO: 411073 - DNA, 587 bp, Homo sapiens
  misc_feature: GZ8MTXP02IWEUG.9.70.G04.1.454.CMB.2.raw
  modified_base (232)..(232): a, c, t, g, unknown or other
  modified_base (237)..(237): a, c, t, g, unknown or other
  modified_base (249)..(249): a, c, t, g, unknown or other
  modified_base (275)..(275): a, c, t, g, unknown or other
  modified_base (287)..(287): a, c, t, g, unknown or other
  modified_base (304)..(304): a, c, t, g, unknown or other
  modified_base (322)..(322): a, c, t, g, unknown or other
  modified_base (357)..(357): a, c, t, g, unknown or other
  modified_base (359)..(359): a, c, t, g, unknown or other
  modified_base (418)..(418): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaacgccttcacacggcccctgtcccctcacctgcactgtctntggtnactccatcgagnggtggtctcatcgcgacgtgcgcgcncgccgcgagagngagatatgtagaatatnagtcgacgtaggcgaccnctactaccaccccgaccctcagagacgtacgtacncntctagtcgacgacgacacgaccctacgactacgtcgtcccacgatacgtagtatatacncgtaccgaccgcgaagtagacccggtagttctagttacctggtggacgacgtaagtacggttaccgtttacgttaggtaaccgactaacgttaaacgtttaaaccgtaaacctccggttaagttcggacggttacggtacggtacggggaccggacggtaaacggtacc

SEQ ID NO: 411074 - DNA, 641 bp, Homo sapiens
  misc_feature: GZ8MTXP02JAI5M.9.70.G04.1.454.CMB.2.raw
  modified_base (234)..(234): a, c, t, g, unknown or other
  modified_base (245)..(245): a, c, t, g, unknown or other
  modified_base (274)..(274): a, c, t, g, unknown or other
  modified_base (333)..(333): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtccctcacctgcactgtctctggtnactccatcagnggtggtcttccatggacctggactccggnacgtccgccggagaagggactggatatagtggaacaattctatgccgaggtcgggaccnctatcctaccgaaccccccgtcctacgaagtacggtcgaagtcagcctagttcgtcaagtccgaactacccgtacccagaaaccctacgttccctccctagaccgtagtagtaacgttatacgtcgacccgccgacgacgacgacggtccgtattacgttacgtgtcggacgtaaggtacggaacggttacccgtttaaggtttaccggaacgtacggtacctttaaaacggttaaaaaccctccgttaaacgttacggtaaccgtacggtacgttcgtacggtcggacccggaacggggtaaacccg

SEQ ID NO: 411075 - DNA, 682 bp, Homo sapiens
  misc_feature: GZ8MTXP02IXD7Z.9.70.G04.1.454.CMB.2.raw
  modified_base (278)..(278): a, c, t, g, unknown or other
  modified_base (290)..(290): a, c, t, g, unknown or other
  modified_base (320)..(320): a, c, t, g, unknown or other
  modified_base (336)..(336): a, c, t, g, unknown or other
  modified_base (358)..(358): a, c, t, g, unknown or other
  modified_base (377)..(377): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtcccctcacctgcactgtctctggtgactccatcagtggtcgtcgttcctacgtggacctggactccggnacgtccgccganaagggactggatagtatggaacgaatctangcccaggtcggacccncatctaccaacccccgtcctanaaagtcgtcgacgttaccnggtcctaatcggtactacggtcgacctaccgtacccgaagtaaacccgtacgttccctacccgtagaacgtacggtagtaaggtttaactagtacggtaaacccgcccgtagaacggtacctaaccgggtcccgttagtaacgtttaccgtgggttacgaaccgtaggtaaggacggttacccgtttaaaggttttacggacccgtaagttaccgtaacgtttaaaaacccgtacgttaacggttacgttcgtaacggtaccggttacggtacggggaccgttaaaacggggaccccttaacggg

SEQ ID NO: 411076 - DNA, 843 bp, Homo sapiens
  misc_feature: GZ8MTXP02JRTA9.9.70.G04.1.454.CMB.2.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtcccctcacctgcactgtctctggtcactccatcaggaggttcggtcgttcctacgtcggacctggactccggcacggtcccggccggacgaagggactgggtaagtattagttggaactaattctaagtcggaccgtaagggttcggggacccctacgtaactacccgtaaacccgaaccccccccggttccctaacgaaaggtacgttacggacgttcaggtcctaagtcgttaccgaacggtacccgaaaccgtacccgtaccctaaacgtaaacccgtacgtttaccctacccgttaagggaactacgggttagttaacgtttaacgtaacgttacccgggaaccccggcccggaaacgaacccgggtaacccgtaacccggggtaccgtttaacggtttaacgtttaccgggttaggtacgggaaccggtaagggtaacgggtaacggggtttaaccccggtttttaaaaggttttaacccggggaaaccgtaaacgggttaaccctttaaaacggtttaaaaaacccttcccgtttaaaacccggttaccggttaaccggttacggtaaccgggtttaccggggtacggggtaaccccggaaacgggggtaacccgttaaacccgggg

SEQ ID NO: 411077 - DNA, 599 bp, Homo sapiens
  misc_feature: GZ8MTXP02GGSCC.9.70.G04.1.454.CMB.2.raw
  modified_base (235)..(235): a, c, t, g, unknown or other
  modified_base (287)..(287): a, c, t, g, unknown or other
  modified_base (336)..(336): a, c, t, g, unknown or other
  modified_base (399)..(399): a, c, t, g, unknown or other
  modified_base (447)..(447): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggccaggactagtgaacgccttcacacggccctgtccctcacctgcactgtctctggtnactcatcgagaggtgtcgtctagtgacctggactccggcacgtccgccgganaaagggctggatatagtaggaactaatctatgacccaggtcgggacccncatacctaccaaccccccgtcctagaagacgtcgaacgtcagctaagtcgacacggtcaaacncccgtacccaagtaaccctagttcccacctagacagttgaacgtttanacgtaccgaccgcgacgaacggtaccgacggtacgtatacttagtggacggagaggaggtacgttacgtttacgttacgactacgtaacttaaacgttaaacctcgtaacgtacggcgtacggtacgtcggacggaccggtacgggactacg

SEQ ID NO: 411078 - DNA, 628 bp, Homo sapiens
  misc_feature: GZ8MTXP02FUIQF.9.70.G04.1.454.CMB.2.raw
  modified_base (389)..(389): a, c, t, g, unknown or other
  modified_base (463)..(463): a, c, t, g, unknown or other
  modified_base (518)..(518): a, c, t, g, unknown or other
tcagtgatacgtctcacgaccggtgctcgatttagtgtagtgtgaagggaaagggcctgtgaaggcttcactattcctggacctcctgtgcaagaacatgaaacatctgtggttcatcctcctcctggtggcagctcccagatgggtcctgtcccaggtgcggctgcaggagtcgggcccaggactagtgaagccttcacgacggcccctgtccctcacctgcactgtctcgtggtcactccatcgaggtggttcggtcgttacctacgtcggaccgtggactccggacacggtcccgccggacgaagggctggaagtatagttaggaacgtaatctagtcggaccgtaggtcgggaccctcactacctaaccaaccccccgtccctanaacgtcgtcgacgtcagctagtcgtaccagtcgaaccacccgtacccaagtaaccctgttccctccgtagacgngttaagtagttacagtccgaccgtccgagtacgacgacgtaccgtataacttcgngcgacgagtagtacgttacgtttacgtacgactacgttaacgttaaacgttaaacctcgtaacgtcgtaacggtacggacggtcggcgggaaccgacgggtaaccgtacg

SEQ ID NO: 411079 - DNA, 644 bp, Homo sapiens
  misc_feature: GZ8MTXP02IBPSZ.9.70.G04.1.454.CMB.2.raw
  modified_base (233)..(233): a, c, t, g, unknown or other
  modified_base (272)..(272): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtgtcttcactggacctggactccggnagtcccgcggcaagggctggagtatagtggacgaatctagtgccaggtcggaccgccagtcctaaccaaccccccgtccctacgaagcgtcgagtccagccaatcgtaccagtccgactacccgtcccaagaaccctacgttcctacccgtgaaccgtagtagtaacgttatacgtcgaacccggtccgaccgaacggaccgtaccgggtaccggttacggttaactttacgtcggttcggaccggtaggacggtacggttacccggttttaaagttttacgggaacctacgtacgttaaacgtttaaaaaccgtccttaacgtacggtaacgtcggtacgtcggtcggggaccgtaacgggaccgtaacgg

SEQ ID NO: 411080 - DNA, 545 bp, Homo sapiens
  misc_feature: GZ8MTXP02FIXGF.9.70.G04.1.454.CMB.2.raw
  modified_base (234)..(234): a, c, t, g, unknown or other
  modified_base (245)..(245): a, c, t, g, unknown or other
  modified_base (335)..(335): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtccctcacctgcactgtctctggtnactccatcagnggtggtcgttcctactggacctggatccggcagtcccgccggcaaggggactgggagtatattggacgaatctatgccagtcggggaccnccatcctacaaccccccgtccctcaagagtcgagtcagcatgtcagtcgacacgtcccagaacccagttcctccctgacagtgacgttatatcgaccgccgcagacacggccgtgtattactgtgcgagagaggtcgttacgtttacgacctagctaacgtaaaaactcctaactacggtcgtggacgtcgtgtcggccgagggtaaccg

SEQ ID NO: 411081 - DNA, 590 bp, Homo sapiens
  misc_feature: GZ8MTXP02FQEEM.9.70.G04.1.454.CMB.2.raw
  modified_base (234)..(234): a, c, t, g, unknown or other
  modified_base (273)..(273): a, c, t, g, unknown or other
  modified_base (283)..(283): a, c, t, g, unknown or other
  modified_base (321)..(321): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtccctcacctgcactgtctctggtnactccatcagaggtggtcttccatggacctggatccggnagtccgcggnaaggggctggatatatggacaatcatgcagtgggaccncatctacaacccccgtcctcaaagcgtcagtcagctaagtcgtacgacggttcgaacctacccgtacccgaaacgaaaccctacgttcctaccccgtgaactagtagtaagtttaatacgtcgacccgccgacgacgaaccgacggtaccgtagtacttactgtgacgagagtacggtcctttaagtttacggaccaagtacttaacgttaaaacctctaacgtacgtcgtacggtacgtcggacgggaccggacggggaccgtaacgg

SEQ ID NO: 411082 - DNA, 675 bp, Homo sapiens
  misc_feature: GZ8MTXP02HPIKA.9.70.G04.1.454.CMB.2.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatcccgggcaggtcccgccggacaaaggggactgggaagttactagtttggaacgaattcctagtggcccaaggtggacccgccattccgtaaacccaaacccccccggttccctacgaaacggtacggttcgacggttcacggcctagtcgtacgagtccgaaactaccgtcccaagaacccagttccctcctagaccgtagtacgagtttactatacggacccgccgacacgacgaccggccggttagtagttaccgtggtgacgaaggaggtaacggtcgtttaacgtttacggaccctaaagtccgttaaacgtttaaaaacctccgttaaccgttaccggtcgttacgggtaaccggttcgggtaccgggggtaccgaacgggggtaacccgtaaaccgggg

SEQ ID NO: 411083 - DNA, 572 bp, Homo sapiens
  misc_feature: GZ8MTXP02FQQNW.9.70.G04.1.454.CMB.2.raw
  modified_base (234)..(234): a, c, t, g, unknown or other
  modified_base (340)..(340): a, c, t, g, unknown or other
  modified_base (368)..(368): a, c, t, g, unknown or other
  modified_base (375)..(375): a, c, t, g, unknown or other
  modified_base (413)..(413): a, c, t, g, unknown or other
  modified_base (432)..(432): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtccctcacctgcactgtctctggtnactccatcagaggtgtcttccactggacctggactccggcacggtcccgccggcgaaagggctggatatagtttggaacaatctatcggaccaggtcgggaacccnctaatccctacaacccccccgtccctanaaacgtntacgagtcagcatgcagtcgacactccagacctagtcnccctgacagtgagttatancgaccgcgacagacacggccgtatacttactgcgacgagagtacggtacgtttagtttacggacctagtacttaaacgttaaaactaccgtacgttaccggtcgacggtacgtcgtacgggaccgacggggactaaacgg

SEQ ID NO: 411084 - DNA, 642 bp, Homo sapiens
  misc_feature: GZ8MTXP02GEL5W.9.70.G04.1.454.CMB.2.raw
  modified_base (233)..(233): a, c, t, g, unknown or other
  modified_base (345)..(345): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtgtcgttcctacgtggacctggactccggcacggtccgccggacaaggggactgggatatagttggaacgtaatctagtcgaccctaggtcgggacccncctactcctaaccgaacccccccgtccctacgaaagacgttcgacgtcagcaagttcgtacacgtcgaaacctaccgtacccaaacgaaaccctacgttcctacccgttagaaccgtacgtacgtaacgttaatacgtacgacccgccgacacgacgacggccgtagtacgttacgtgtcgacggagacgtaggtaccgtttaagtttacggacgtacgtaacgttaacgttaaaacctccgtaacgtacggtcgtacggtacgtcggtacggtacgggtacggacggtaaacccgg

SEQ ID NO: 411085 - DNA, 596 bp, Homo sapiens
  misc_feature: GZ8MTXP02FVLEY.9.70.G04.1.454.CMB.2.raw
  modified_base (320)..(320): a, c, t, g, unknown or other
  modified_base (335)..(335): a, c, t, g, unknown or other
  modified_base (358)..(358): a, c, t, g, unknown or other
  modified_base (372)..(372): a, c, t, g, unknown or other
  modified_base (435)..(435): a, c, t, g, unknown or other
  modified_base (478)..(478): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggactccggcaggtcccgccggacaaggggactggaatatagtggacaatctangccaggtcgggaccncatcctacaaccccccgtcctanaagcgtcgagtccngcatgtcagtcgaacaccgtacccaacgtaacccacgttcctccctagacagtacgtagttanagtcgaacccgccgacacgacgacggtccgttagtacttacgngtcgacgtagagtacggtacgtttaacgtttacgaccgtagtacttaaacgttaaaacctccgtaacgttaccgtaacgtacggtacgtcgtgtacgggaccggtaaggggtaacccg

SEQ ID NO: 411086 - DNA, 618 bp, Homo sapiens
  misc_feature: GZ8MTXP02IWIPH.9.70.G04.1.454.CMB.2.raw
  modified_base (234)..(234): a, c, t, g, unknown or other
  modified_base (246)..(246): a, c, t, g, unknown or other
  modified_base (287)..(287): a, c, t, g, unknown or other
  modified_base (449)..(449): a, c, t, g, unknown or other
  modified_base (509)..(509): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtcccctcacctgcactgtctctggtnactccatcaggnggtggtcttcctatggacctgactccggcagtccgaccggnaagggactggagtatagtggaactaatctatcgacccgtaggtcgggacccgcactaccgtaacctaaccccccggtcccctaagaaagtcggttaccgagttccaggctaagtcgtcaagtcgactaccggtacccaagaaccctagtctcccgtgaaccngtgtagttactacgtcgaacccgccgacaagacccgtacgggtccgtagtaacttgtcgngacgagagtacgttacgtttacgttacgaactacgtaacgttaaacgttaaacctaccgtaacgtacggtcgtcggtaccgtcgggtacgggtacgtacgggactacgg

SEQ ID NO: 411087 - DNA, 573 bp, Homo sapiens
  misc_feature: GZ8MTXP02I3AB2.9.70.G04.1.454.CMB.2.raw
  modified_base (233)..(233): a, c, t, g, unknown or other
  modified_base (244)..(244): a, c, t, g, unknown or other
  modified_base (286)..(286): a, c, t, g, unknown or other
  modified_base (335)..(335): a, c, t, g, unknown or other
  modified_base (361)..(361): a, c, t, g, unknown or other
  modified_base (386)..(386): a, c, t, g, unknown or other
  modified_base (411)..(411): a, c, t, g, unknown or other
  modified_base (419)..(419): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagnggtgtcgttcctactggacctggatccggcagtccgccgganaacgggactggatatagttggacaatctatcgaccgaggtcgggacccncagtctaaccaacccccgtcccctanaagacgtcgaagtcagcagtgtacngtcgacacgtccagaaccagttacnccctgacngtgtagttatagtcgaccgccgacacgacacggtcgtagttacttacgtgtcgagagagtacggtctttaagtttacgacctagtactaacgttaaaactccttacgtaacggttcgtacggtacgttcgtggtacggcgtaacgggtaacccg

SEQ ID NO: 411088 - DNA, 712 bp, Homo sapiens
  misc_feature: GZ8MTXP02JUNOH.9.70.G04.1.454.CMB.2.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggcccaggactagtgaagccttcacaggccctgtcccctcacctgcactgtctcgtggtgactccatcgaggaggttggttccgttcctacgtggaccctggtacgtcccgggctacggtcccggccggacgaaggggtactgggacgttagttagttagggaactaaatctagtcgaccgacgggtcgggacccgccacgtcctaaccaacccccccgtcctaacgaagacgtcgtacgtcacgtcagtccgtacgagttccggaacctacccgtacccaaaggtaaaccccttcgttacccctacccgtagaaccgtaggttacggtaaagtttacgacgtaccggaaccccggccacggtaaccgaccggtaccggggtccgtttagttaacgttcgtggtacggacggtaggtacggtacggttcgttttaacgttacgggacctaggtaaaccttaaacgttaaacctccgttaacgtcggtaacgtcgggtaaccgttggggaccggggacgtaacggggtactaccggg

SEQ ID NO: 411089 - DNA, 557 bp, Homo sapiens
  misc_feature: GZ8MTXP02I1B6J.9.70.G04.1.454.CMB.2.raw
  modified_base (235)..(235): a, c, t, g, unknown or other
  modified_base (271)..(271): a, c, t, g, unknown or other
  modified_base (280)..(280): a, c, t, g, unknown or other
  modified_base (290)..(290): a, c, t, g, unknown or other
  modified_base (317)..(317): a, c, t, g, unknown or other
  modified_base (336)..(336): a, c, t, g, unknown or other
  modified_base (408)..(408): a, c, t, g, unknown or other
  modified_base (444)..(444): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtcccctcacctgcactgtctcgtgtnactccatcagagtgtcttctactggacctgatccgnagtccgcgnaaggctgatntagtggacaatctatgccagcggaccncatcaccacccccgtcctnaagcgtcgatcgagcaagtgtaccaggtcactacccgtcccaagaccagttctccctgactagtatagttanacgtgaccgcgcaacgcaccggcgttatacgttcgngtcgcgaagagaggtaccgtttaagttacggacctagtaccttaagttaaaacctcttaccgtacggtcgtacgggtacgtaccggtaggggcctaacggggaacctaacggg

SEQ ID NO: 411090 - DNA, 716 bp, Homo sapiens
  misc_feature: GZ8MTXP02F1PDT.9.70.G04.1.454.CMB.2.raw
  modified_base (235)..(235): a, c, t, g, unknown or other
  modified_base (441)..(441): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggaggtcgggcccaggactagtgaagccttcacacggccctgtccctcacctgcactgtctctggtnactccatcagaggtgtcgttcctagtcggacctggacgtccggcacggtcccgccggacgaagggctaggactatagtacggaactaatctaagtcgacccgtaggtcgggacccacctactcctaaccgaacccccccgttcccctagaaacgtacggttcgaacgtcgacggtacctagttcgtaccgtacgttacgaaacccnccgttaacccgacgtaaacccgtacgttcctacccgtagtaccgagttacggtaattacgtacgacccgaccggtaccgacgacggtaccgtaccgtacgttacgttacttaccggtgtaccggtcggaagtaacggggtacggtttacccgttttaaggtttacggacccgtttaaggtaaaccgtttaaacggttaaaaacccttccggttaaccttacgggttcgtaaccgggtacgtacgtcggggtacggacccggtacgggtaaacccg

SEQ ID NO: 411091 - DNA, 784 bp, Homo sapiens
  misc_feature: GZ8MTXP02GFRSH.9.70.G04.1.454.CMB.2.raw
  modified_base (371)..(371): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtccctcacctgccactgtctctggtcactccatcgagtaggtgtcgttacctactggacctggactccggacacggtcccgaccggcgaaaggggacctggagttaactagttacggaacgtaaatcgtaagtcggacccgtaagggttccggggaaccccncctaacgttacccgtaaaaccccgtaaaccccccccggttccccctaacggaaaagggtacggttaccgtaacggttaccgacggtaccctaaggtttccgttaaccgaacggtttacccgaacccgtaaacccggtaccccctaaacggtaaacccgttacggtttccctaccccgttagaaccgtaggttacgtaaagtttactacgccgacccgccgagacgacgaccggtccgttagtacgttacgtgtacggacggaagtacgtacggttacccgtttaagtttaacggaccgtaacggttaccgttaaaacgttaaaaccgttcccgttaaacggttaccggtaacggttacggtaccggtttacggggtaccggggaaaccggtaccggggaacctttaaaccggg

SEQ ID NO: 411092 - DNA, 590 bp, Homo sapiens
  misc_feature: GZ8MTXP02FH54I.9.70.G04.1.454.CMB.2.raw
  modified_base (245)..(245): a, c, t, g, unknown or other
  modified_base (376)..(376): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtccctcacctgcactgtctctggtgactccatcagnggtgtcttcctatggacctggactccggcaggtcccgccggacaagggctggagtatattggacgtaatctagtgccgaggtcggggacccgccatcctaaccaccccccgtccctacaagagtcgagtcngcatgtacagtcacaccgtcccaagaaccctacgttcctcctagacagtagagttatagtcgaccgccgacgacgaccgacgggccgttagtaacttacgtggtcgacgaggagacgggtaccgtttacgtttacggaactacgacttaacgttaaaacctcgtaacgtacgtaacgtcggtacgtcggacgggtaccgacggggacctaacgg

SEQ ID NO: 411093 - DNA, 777 bp, Homo sapiens
  misc_feature: GZ8MTXP02JW9KN.9.70.G04.1.454.CMB.2.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtcccctcacctgcactgtctcgtggtcacctccatcgaggtagggttcgttccgttaccgtacgtcggacctgggacgtccggacacggtcccggaccggacgaagggtctagggattagttacgttaggaactaatacgtagtcgaccgtaggtcgggacccacctacgtccctaacccgtaacccccccgtcctacgaaacgtacgtcgagttcagtcagtcgtacgacgtaccgaccgacccgtaaccagtaaaccctcgttcccgtaccgagaccgtagttagtaacgtttaataccgaccggacccgccggtaacgaacccggacggtacccgttcgggttaagttaaccgtttacggagggcggtaacggaacggttaacgggtaccgggtttttaaccggtttaaacggtttacccgggaaaccgtacgtttaccgtttaaaaaccgtttaaaacccgttcccggtttaaaaccggggtttccgttaaccgggttaacggggttacccggttacgggggtaccccgggggtacccggaacggggtaacccgttaacccgggg

SEQ ID NO: 411094 - DNA, 694 bp, Homo sapiens
  misc_feature: GZ8MTXP02JIO6K.9.70.G04.1.454.CMB.2.raw
  modified_base (234)..(234): a, c, t, g, unknown or other
  modified_base (346)..(346): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctcgtggtnactccatcgaggaggtcggtcgttcctaactcgggacctggactccggcacggtcccgccggacgaagggctgggattatagttggaacgatctatgaccaggtcgggaccncctataccgtaaccaacccccccgtcctacaagtacgtcgacgtcaggcagtcgtacacgtcgaaccaccgtacccgaacgtaaacctacgttcctacccgtagactacggttagtaacgttaacgtacgttaccgaaacccggcccgaacgaacggtaaccggaaccgggtccgtttacgttaaaccgttaccgttggtacgacggaacggtaacgggtacggttaacccggtttaagttttaacggaccgtacgtaaaccgttaaacgtttaaaaccgttcccgttaacgttaccggtcgttacggtaccgtacggttcggtacggtaccggaacggggtaacccg

SEQ ID NO: 411095 - DNA, 577 bp, Homo sapiens
  misc_feature: GZ8MTXP02FGLEN.9.70.G04.1.454.CMB.2.raw
  modified_base (233)..(233): a, c, t, g, unknown or other
  modified_base (300)..(300): a, c, t, g, unknown or other
  modified_base (310)..(310): a, c, t, g, unknown or other
  modified_base (327)..(327): a, c, t, g, unknown or other
  modified_base (361)..(361): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggccaggactagtgaagccttcacaggcccctgtccctcacctgcactgtctctggtnactccatcaggaggttgtcgttcctactggaccctggactccggcagtccgcggcgaaggctggatntagtgagatntatgcagtcgggacccncatacctaccacccccgtccagagcgtacgatcngcatcgtacacgtacgaccaccgtacccaacgtaaacctacgttacctaccgtacgtacgtagtacgtagttatacgtaccgaccgccgacgacgaccgacgtcgtagtacttacgtgtagacgagacggtacgttacgtttagttacgactacgtacttaaacgttaaacctctacgtacgtcgtcggacgtcggacggaccggacggacgtacg

SEQ ID NO: 411096 - DNA, 737 bp, Homo sapiens
  misc_feature: GZ8MTXP02IZXUI.9.70.G04.1.454.CMB.2.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcaggaggtcggtcgttcctactggacctggactccggcacggtcccggccggcgaaggggacctggacgtattagttggacgtaatcttagtcgacccgaggtcgggaccccgcctactcctaacccaacccccccggtttccccctagaaacgtacgtaccgaacgttccaggtcctaagttcggttaccaacggttacccgaaaccgtacccggtacccccgaaggtaaaccccgttacgtttccccttaccccgttagaacccgttagggttaacgtaacgttttaaactaacgttaccggacccggccccgtacgaaacgggtacccgaaccgggtcccgtttagttaacgtttacgtggttcggacgaggtaacgtacggttacccgtttaaggttttaacgaccgtacgtacgttaaacgttaaaacctccgttaacgttacggtcgtacggtacgttcggtacggggaccgtacggggaaccttaacggg

SEQ ID NO: 411097 - DNA, 795 bp, Homo sapiens
  misc_feature: GZ8MTXP02I0D7J.9.70.G04.1.454.CMB.2.raw
  modified_base (230)..(230): a, c, t, g, unknown or other
  modified_base (235)..(235): a, c, t, g, unknown or other
tcagtgatacgtctcacgaccggtgctcgatttagtgtagtgtgaagggaaagggcctgtgaaggcttcactagtcctggacctcctgtgcaaagaacatgaaacatctgtggttcatcctcctcctggtggcagctcccagatgggtcctgtcccaggtgcggctgcaggagtcgggccaggactagtgaagccttcacaggcccctgtcccctcacctgcactgtctntggtnactccatcgagtaggttcgttcttcctacgtcggactggactcccggctacggtcccgccggtacgaaacggggtactggtaagtacttaaggttaggaaactaatcttaacgtcggaccccgtagggttccggggaacccctacctaacgtttaccctaacccgaaacccccccccggttccccctaacgaaaaggtaccgttacgacgttacacggtaccagttaccgggtactaacgggtcgaaacctaacccgtacccgaaacgttaaacccttagtttccctacccgttagaaccgtaggttacgtaaaggtttacaacgttcgaaaccccgtccgaacgaacggtaaccgacccgggttccgtttaagttaccgtttacgtaggtacggacggtaacgtacggtaacggtttaccgtttttaaaggttaacccggaaccgttagtaaaccgtttaaaacgttaaaacgttacccgtaaccggtacggtttaacgtacggggtaaccgttacgggtacgggggtaacccgtaacgggggaactttaaaccccggg

SEQ ID NO: 411098 - DNA, 805 bp, Homo sapiens
  misc_feature: GZ8MTXP02IO5L4.9.70.G04.1.454.CMB.2.raw
  modified_base (407)..(407): a, c, t, g, unknown or other
  modified_base (669)..(669): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggcccaggactagtgaacgccttcacgacggccccttgtccccgtcacccttgccacgttcgttccttcgtcggttcgaacctcccaattcgaaggtagggttcggttccgttcccgtacgtcggaccctgggactcccgggcacggttccccggccgggataacggggaccttgggaacgtagttaagttcgggaactaatcgtaagtgacccgtaggtcggggaccccncctaatacccgtaacccgtaacccccccgttcccctaagaaaacgggtcggttaccgacggttaccagggcctaaacttcggggttaccaaacgggggtttaccaaaacccgcccgggttaaaccccgaaacgtaaacccctttacggttcccctacccgtagaacgtacggttacgtaatttaaacgacgtaccggaccccgtacgacgtaaacggacccgtacgggtccgttaagttaacgtttagcgggtacggaacgnggtacggtacggttaaccgtttttaaacgtacggaaccggtaacgtttacttaaaaacgttaaacccgttcgttaaccgtacgggtaacgttcgggtacggtcgggtaccggggaaccggtacggggaacctaacg

SEQ ID NO: 411099 - DNA, 551 bp, Homo sapiens
  misc_feature: GZ8MTXP02HV8BN.9.70.G04.1.454.CMB.2.raw
  modified_base (233)..(233): a, c, t, g, unknown or other
  modified_base (271)..(271): a, c, t, g, unknown or other
  modified_base (308)..(308): a, c, t, g, unknown or other
  modified_base (320)..(320): a, c, t, g, unknown or other
  modified_base (369)..(369): a, c, t, g, unknown or other
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtcgtcttcatggacctggatccggnagtccgcggcaagggctggatatatggaacaatctangccagtggaccncatcacaacccccgtcctacagagtcgatcagcatcgcaaggtcaaacncgtacccaacgaaccacgttcctcccgtacgacgtacgtagaagtttatagtacgaaccgccgacgacgaccgacggcgtagtactactgttagcgtagagaggtacgttagtttacgacagacttaacgttaaaactcctactaacgtgtacgacgtcgtagggaccgagggacctaacgg

SEQ ID NO: 411100 - DNA, 528 bp, Homo sapiens
  misc_feature: GZ8MTXP01EPXR9.17.28.C06.1.454.CMB.2.raw
  modified_base (474)..(474): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagcccaccctcagtgtctcgggacccccgggcagagggtcaccatatcttgttctggaaacagctccggcatctcaaactaaacatttttgctggtaccagcaattcccaggactccggccccccgactcctcatctatagaaatgatcatccggccctccgggtccctgaccgattctctggctccaatgtctgcacctcacgccctcctgaccatcagtcggctccggtcgaggatgaggctgattattacgtgtgcacggtggatgacatcctgaattgggtccggtgttcgggnggagggaccgaggcttcgccgttcctaagtcaacgcccaggcctcgccccgtcg

SEQ ID NO: 411101 - DNA, 699 bp, Homo sapiens
  misc_feature: GZ8MTXP01BDURX.17.28.C06.1.454.CMB.2.raw
  modified_base (235)..(235): a, c, t, g, unknown or other
  modified_base (241)..(241): a, c, t, g, unknown or other
  modified_base (256)..(256): a, c, t, g, unknown or other
  modified_base (267)..(267): a, c, t, g, unknown or other
tcagcgtagactagcacgaccggtgctcgatttagagctcacgtattgggtttgggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggcagagggtcaccatatcttgttccggaaacngctcgnatctacaactaactntttgctgacanctactccagctcccgccccactcctcatctaataagaatgactcacgtccggccccgtccgggtccctacgtaccgtacttcctcgtcggtccctccaagttcgtcgtcggccctacccgtccaccgtcccctacccgtacgaccctacgtccgtacgggtccgggtcccgttcccggggtaccggtaagggtacgtacgggacgggtcgttaggttaacgtttaacgtttaaccggttggttaccggtaccggtaaccgggttagggtaacgtcgtaaaccgtacgttaccgtaaggtaacggttcggggttcccggggttgggttccggggacggggtaccgggaccgtacgggtccgttaccgggttacccgttaccgtaacgtccgaaccggtaccccgtacggttcccgtcccggttcccccgtcgg

SEQ ID NO: 411102 - DNA, 521 bp, Homo sapiens
  misc_feature: GZ8MTXP01AIG38.17.28.C06.1.454.CMB.2.raw
  modified_base (207)..(207): a, c, t, g, unknown or other
  modified_base (237)..(237): a, c, t, g, unknown or other
  modified_base (349)..(349): a, c, t, g, unknown or other
  modified_base (501)..(501): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggnagggggtcaccatatcttgttctggaaacngctccggcatctcaactaaacatttttgctggtaccagcaattcccaggactccggccccccgatcctcatctatagaaatgatcatcggccctcgggtcctgaccgattcnctggctccaatgtctggccacctcagccctccctgacccatcagtgggctccggtccgaggatgaggctgattatacgtgtgcaccggtgggatgacatcctgaatggtccggtgttcgggcgggagggccagggcttgccgttctaagtcncgccaggctcgccccgtcgg

SEQ ID NO: 411103 - DNA, 557 bp, Homo sapiens
  misc_feature: GZ8MTXP01DPJO4.17.28.C06.1.454.CMB.2.raw
  modified_base (208)..(208): a, c, t, g, unknown or other
  modified_base (238)..(238): a, c, t, g, unknown or other
  modified_base (453)..(453): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggnagagggtcaccatatcttgttctggaaacngctccggcatctcaaactaaactatttttgctggtaccagcaaattccccaggactccggccccccgactcctcatctaataagaaatgatcatccggccctccggggtccctcgacccccgattctcgtcgcctccattgtctggccacctcacgcccctccctcgaccatcgagtgggcctccggtccgaggatgacgctagattatactgtncgacgtggatgacatcctagacgtgggtccggtggttcgggcggagggacccgaggcgttcggaccgtcctaagtcacggcccgaacggccttccggccccccg

SEQ ID NO: 411104 - DNA, 711 bp, Homo sapiens
  misc_feature: GZ8MTXP01EPS1U.17.28.C06.1.454.CMB.2.raw
  modified_base (242)..(242): a, c, t, g, unknown or other
  modified_base (444)..(444): a, c, t, g, unknown or other
  modified_base (455)..(455): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggcagagggtcaccatatcttgtctggaaacagctccgnactactacaactaaacttatttgtcgtacgtaacacgactaacttacccgacggacgtccccggccccccgaccctcctactactactaataaagtaatagtactactacgtccggtccccggtccccggggtcctaccgtacccgtacttctcgtcggtcctaccctatcgtcgtcggaccaccctcacgtccctccctanacctatcgggnggtcggtccgtccggacgagagtgacgtcttagttaattttaacgttcggtggaccgtacccggtaacggggtgtatacgtaaacctcgttccggtagggtacgggtttccgggggttccggtttacgggggttcccgggggaaacggggaccggaaaccgttcggttcccggttacccgttaaaccccggtttaacgtaaacggtcccgaacccggtaccccggttacggtcccccgttcccccggtaacccccg

SEQ ID NO: 411105 - DNA, 515 bp, Homo sapiens
  misc_feature: GZ8MTXP01DKHMK.17.28.C06.1.454.CMB.2.raw
  modified_base (236)..(236): a, c, t, g, unknown or other
  modified_base (456)..(456): a, c, t, g, unknown or other
  modified_base (478)..(478): a, c, t, g, unknown or other
  modified_base (483)..(483): a, c, t, g, unknown or other
  modified_base (498)..(498): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggcagagggtcaccatatcttgttctggaaacngctccggcatctcaactaaactatttttgctggtaccagcaaattcccaggactccggccccccgactccctcatctatagaaatgatcagtccggcccctccggggtccctgaccccgattctctggctaccatcgtctggcacctcacgccctccctgaccatcgagtcgggctccggtccgaggatgagctgattagtactgtgcacgtggatgacntctgatggtcgtgttcggcggnggacngcttcgacgtcagcncgccagcttcgtccccg

SEQ ID NO: 411106 - DNA, 579 bp, Homo sapiens
  misc_feature: GZ8MTXP01AKF5U.17.28.C06.1.454.CMB.2.raw
  modified_base (371)..(371): a, c, t, g, unknown or other
  modified_base (442)..(442): a, c, t, g, unknown or other
  modified_base (445)..(445): a, c, t, g, unknown or other
  modified_base (450)..(450): a, c, t, g, unknown or other
tcagcgtagactagcacgaccggtgctcgatttagagctcacgtattgggtttgggaggtctcagagaggaggcttagccctggactccaaggcctttccacttggtgatcagcactgagcacagaggactcaccatggagttggggctgaactgggtttccttgttgctgttttagaaggtgtccagtgtgaggtccagttggttgagtccggggaggcctggtccagcctgggggtccctgagactctcctgtgcagcctccggattccccttcagtagttatggatgacttgggtccgccagactccagggaaggggctgggagtgggtggccaacataaagcaagatggaactgcccgagtttacgnggactctgtgaagggccgtttcaccatctcagagacaacgccaagaattcactgtatctacaactgaaacngcnggagngtcgacagacgacggccgtagtacttctgtgcgaagagttggtaaaggaaaaagtacgtggttcgttggttaggtttaacggtcgggggaaccgtaagggggacgttcccgttgggttccctaacccgg

SEQ ID NO: 411107 - DNA, 503 bp, Homo sapiens
  misc_feature: GZ8MTXP01CF1H1.17.28.C06.1.454.CMB.2.raw
  modified_base (364)..(364): a, c, t, g, unknown or other
  modified_base (471)..(471): a, c, t, g, unknown or other
  modified_base (495)..(503): a, c, t, g, unknown or other
tcagcgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatccggccccccgactcctcatctatagaaatgatcatcggccctccggggtccctgaccgattctctggctccatgtctggcacctcagccctccctgaccatcagtgggctccggtccgaggatgaggctgattatactgtgcacgtgggatgacntcctgatgggtccggtgtcgggcgggagggcaggctgaccgtctaagtcagcccaagctcgcccctcggtcactctcgtccccgccctcctcctagtctacgctggngcgggctggcaaggcgcagttagnnnnnnnnn

SEQ ID NO: 411108 - DNA, 586 bp, Homo sapiens
  misc_feature: GZ8MTXP01AB5ER.17.28.C06.1.454.CMB.2.raw
  modified_base (376)..(376): a, c, t, g, unknown or other
  modified_base (402)..(402): a, c, t, g, unknown or other
  modified_base (407)..(407): a, c, t, g, unknown or other
  modified_base (424)..(424): a, c, t, g, unknown or other
  modified_base (496)..(496): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattccccttcagtattatggatgacttgggtccgccagactccagggaaggggctgggagtgggtgccaaacataaaagcaaagatggaactgccccgagttttacggngactctgtagaaggtccttcacatcncaganacaacgcaaagatcatntatactaacaactgaaacacgtcctagggaagacgtcgacaagaccgacgggtccgttagtaattctgtcgngaagagttaggtaaaggaaaagtaaagtaggttgttggttaggtttaaggttggggtcggacgggacggttccgtcggttccgtaacccg

SEQ ID NO: 411109 - DNA, 531 bp, Homo sapiens
  misc_feature: GZ8MTXP01E5CU0.17.28.C06.1.454.CMB.2.raw
  modified_base (236)..(236): a, c, t, g, unknown or other
  modified_base (381)..(381): a, c, t, g, unknown or other
  modified_base (447)..(447): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggcagagggtcaccatatcttgttctggaaacngctccggcatctcaaactaaactatttttgctggtaccagcaaattcccaggactccggccccccgactcctcatctatagaaatgatcatccggcccctccggggtccctgaccccgattctctggctccatgtctggcacctnacgccctccctgaccatcagtggctccgggtccgaggatgaggctgattattactgtgcacgtggntgacatcctgaagtggtcggtgttcgggcggaggaccgaggcgttcgaccgtctaagtcacgcccgaaggtccttcgtcccccg

SEQ ID NO: 411110 - DNA, 515 bp, Homo sapiens
  misc_feature: GZ8MTXP01DROM2.17.28.C06.1.454.CMB.2.raw
  modified_base (371)..(371): a, c, t, g, unknown or other
  modified_base (507)..(515): a, c, t, g, unknown or other
tcagcgtagactagcacgaccggtgctcgatttagagctcacgtattgggtttgggggtgtggtggtctccactcccgcccagtctgtgctgactcagccaccctcagtgtctgggacccccgggcagagggtcaccatatcttgttctggaagcagctccggcatctcaactaaactatttttgctggtaccagcaattcccaggatccggccccccgactcctcatctatagaaatgatcatcggccctccggggtcctgaccgattctctggctccatgtccggcacctcacgccctcccctgacccatcagtgggctccggtcgaggatgaggctgattatactgtcgcacgtgggatgaacatccngaatgggtcgtgtcgggcggaggccaggctgaccgtcctaagtcacgccaacggctcgccccctcggtccacgttcctcgttccccacccctcctcctcgtcctacgctgacggccgggctggcaaggcgcatagnnnnnnnnn

SEQ ID NO: 411111 - DNA, 579 bp, Homo sapiens
  misc_feature: GZ8MTXP01C3KBL.17.28.C06.1.454.CMB.2.raw
  modified_base (467)..(467): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaactattttgctggtaccagcaaattcccgaggactccggccccccgatcctcatctatagaatgatcatcggccctccggggtcctcgaccccgattctctcggcctccatgtcctggcctacctcacgccctccctcgaccatcgagtcgggcctccgggtaccgaggatggaggtctagtatttagttactgtcgcaccgtggatgacntcctgaagtgggtccggtggttccgggacgggacgggacccgagggttccgttcggttaacccgttccgtaaacgtccgaacggccccgaagggtccgttccggtccccccg

SEQ ID NO: 411112 - DNA, 554 bp, Homo sapiens
  misc_feature: GZ8MTXP01D12UF.17.28.C06.1.454.CMB.2.raw
  modified_base (441)..(441): a, c, t, g, unknown or other
  modified_base (481)..(481): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattccccttcagtagttattggatgacttgggtccgccagactccagggaaagggctggagtgggtggccaaacataaagcaagatggaactgccgtagttttacgtggactctgtgaagggccgtttcaccatctccagagacaacgcaagaattcactgtatctacaactgaaacngcctgaggagtcgcagacacggccgtgtattactgtgcgngaatgagggaaaaagttaagtgggacttgttgtttagttgggggcctaagggagcccttgggtccaaccgtcc

SEQ ID NO: 411113 - DNA, 573 bp, Homo sapiens
  misc_feature: GZ8MTXP01EQ19I.17.28.C06.1.454.CMB.2.raw
  modified_base (377)..(377): a, c, t, g, unknown or other
  modified_base (510)..(510): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggaggcctggtccagcctgggggtccctgagactctcctgtgcagcctccggattccccttcagtagttatggatgacttgggtccgcagactccagggaaggggctgggagtgggtggccaaacataaaagcaaagatggaaactgccccgagttttacgnggacctcgtgaggcggttctacactctccacgagaacacaaccgacaaagtactacagtaatactactaaacagacaaacgactcgaggggaagtcgacacgaacgaccgtacggtcgttattactagtgagngaatgttaggaaagttaaaagtggcttgttgttagtttgggcgcggagccgcgttggcctccg

SEQ ID NO: 411114 - DNA, 560 bp, Homo sapiens
  misc_feature: GZ8MTXP01B741D.17.28.C06.1.454.CMB.2.raw
  modified_base (206)..(206): a, c, t, g, unknown or other
  modified_base (353)..(353): a, c, t, g, unknown or other
  modified_base (390)..(390): a, c, t, g, unknown or other
tcagcgtagactagcacgaccggtgctcgatttagagctcacgtattgggtttgggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggnagagggtcaccatatcttgttctggaaacagctccggcatctacaactaaactattttgctggtaccagcaattcccaggactccggcccccactcctcatctatagaaatgatcacgtccggccctccggggtccctgaccccgtnttctctgctccatgtctggccacctcacgcctccctnaccatcgacggtggccttccggttcgaggtatggacggtctagtactttagttacgtgtcgcaccggtggatgactagtccgtagtacgtcgggtccggtggttcgggcggacgggaccagggttccgttggacccgtcctagccacgtcccagggcccttcgtcccccg

SEQ ID NO: 411115 - DNA, 550 bp, Homo sapiens
  misc_feature: GZ8MTXP01DMQTY.17.28.C06.1.454.CMB.2.raw
  modified_base (277)..(277): a, c, t, g, unknown or other
  modified_base (374)..(374): a, c, t, g, unknown or other
  modified_base (469)..(469): a, c, t, g, unknown or other
  modified_base (489)..(489): a, c, t, g, unknown or other
  modified_base (496)..(496): a, c, t, g, unknown or other
  modified_base (536)..(536): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagccgtgggggtccctgagactctcctgtgcagcctccggattcccctnagtagttatggatgacttgggtccgcagactcgagggaaggggctggagtggtgccaacataaaagcaaagatggaaactgccccgtagttttacgnggactctagtgaaggggcctttcaccatctcagacgacaaacgccaaagaattcaactgtaatctaacaaactgaaacagccctggaagagtcgnaagacacggcgtgtatctgngcaagangtaagaaaagtatcggattgttgtttaatggggcaggganccctggctaacccg

SEQ ID NO: 411116 - DNA, 570 bp, Homo sapiens
  misc_feature: GZ8MTXP01EX59P.17.28.C06.1.454.CMB.2.raw
  modified_base (206)..(206): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggnagagggtcaccatatcttgttctggaaacagctccggcatctcaaactaaacatttttgctggtaccagcaaattcccaggatccggccccccactcctcatctataagaaatgatcactcggcccgtcccggggtccctcgaccccgacttctctcgctccatcgtctggcacctcacgccctccctcgaccactcaggtcggcgtcccggtccggtaggatggagggctagtattaagttactgtgcgaccgtggggatcggactactccgtagtagtcgggtccgggttgttcggggcggacgggaccgtggcgttcggttacccgtcgtaagtcgccgacccgaggtccgcccgtccccg

SEQ ID NO: 411117 - DNA, 528 bp, Homo sapiens
  misc_feature: GZ8MTXP01BZ8GQ.17.28.C06.1.454.CMB.2.raw
  modified_base (449)..(449): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggcagagggtcaccatatcttgttctggaaacagctccggcatctcaactaaactattttgctggtaccagcaattcccaggactccggccccccgactcctcatctatagaaatgatcatcggccctcggggtccctgaccccgattctctggctcccatgtctggcacctcacgccctccctgaccatcaggtggctccgggtccgaggatgaggctgtattatactgtgcaccgtggatgacngtcctgaagtggtcggtggttcgggcggagggacccagggcttggacccgtctaagtcacgccaggccttcgtcccccg

SEQ ID NO: 411118 - DNA, 495 bp, Homo sapiens
  misc_feature: GZ8MTXP01CT4R9.17.28.C06.1.454.CMB.2.raw
  modified_base (345)..(345): a, c, t, g, unknown or other
  modified_base (482)..(482): a, c, t, g, unknown or other
  modified_base (492)..(495): a, c, t, g, unknown or other
tcagcgtagactagcacgaccggtgctcgatttagagctcacgtattgggtttgggggtgtggtggtctccactcccgcccagtctgtgctgactcagccaccctcagtgtctgggaccccgggcagagggtcaccatatcttgttctggaaacagctccggcatctcaactaaacatttttgctggtaccagcaattcccaggatcggccccccaactcctcatctatagaaatgatcatcggccctcggggtccctgaccgattctctggctccatgctggcacctcacgccctccctgacccatcagtgggctccggtccgaggatgaggctgattattacngtcgcacgtggatgaacatcctgaatgggtccggtgtcgggcggagggaccaggctgaccgtcctaagtcacgcccaaggctcgcccctcggtccactctcgttccccgcctcctcctacgtctacgctgcgcggcnggcaggcagnnnn

SEQ ID NO: 411119 - DNA, 514 bp, Homo sapiens
  misc_feature: GZ8MTXP01AHYVD.17.28.C06.1.454.CMB.2.raw
  modified_base (372)..(372): a, c, t, g, unknown or other
  modified_base (501)..(501): a, c, t, g, unknown or other
  modified_base (507)..(514): a, c, t, g, unknown or other
tcagcgtagactagcacgaccggtgctcgatttagagctcacgtattgggtttgggggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggactccggccccccgactcctcatctatagaaatgatcatccggccctccggggtcctgaccgattctctggctccatgctggcacctcagccctccctgacccatccagtgggctccggtccgaggatgaggctgattattactgtcgcacgtgggatgaacatccngatgggtccgtgttcgggcggagggaccaggctgaccgtcctaagtcagcccaaggcctcgcccctcggtccacgtctcgttccccgccctcctcctagtcctacgtctgacggcggctggcaagggcncatagnnnnnnnn

SEQ ID NO: 411120 - DNA, 603 bp, Homo sapiens
  misc_feature: GZ8MTXP01CLWLF.17.28.C06.1.454.CMB.2.raw
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcggggacccccgggcagagggtcaccatatcttgttctggaaacagctccggcatctacaactaaactatttttgctggtaccagcaattcccaggactcccggccccccgactccctcatctatagaaatgatcactccggcccgtccggggtccctgaccgtacttcctcgtcggcctccaattcgtctggccacctcacgccctcctcgacccatcgagtcgggcctccgggtcgaggtatggacggctagtacttattacgtgtcgccgtacggtgggatgactacgtccgtagtaacgtcggggtccgggttggttccggggcgggtaacgggccgtagggtccgttacggttcccgttaccgtaacggtccaacggccccgaggccctccggcccccgttccgg

SEQ ID NO: 411121 - DNA, 499 bp, Homo sapiens
  misc_feature: GZ8MTXP01BXGBF.17.28.C06.1.454.CMB.2.raw
  modified_base (469)..(469): a, c, t, g, unknown or other
  modified_base (493)..(499): a, c, t, g, unknown or other
tcagcgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctctggcatctcaactaaacatttttgctggtaccagcaattcccaggatcggccccccgatcctcatctatagaaatgatcatcggccctccggggtccctgaccgattctctggctccatgtctggcacctcagcctccctgaccatcagtggctccggtccgaggatgaggctgattattacctgtgcaccgtgggaatgaacatcctgaatgggtccggtgttcggcggaggaccaggctgacgtctaagtcagcccagctgcccctggggtcactctcgttcccgccctctcctagtctacgctgngcgggcttgggcaggcgcagttgnnnnnnn

SEQ ID NO: 411122 - DNA, 575 bp, Homo sapiens
  misc_feature: GZ8MTXP01CPWKV.17.28.C06.1.454.CMB.2.raw
  modified_base (208)..(208): a, c, t, g, unknown or other
  modified_base (239)..(239): a, c, t, g, unknown or other
  modified_base (480)..(480): a, c, t, g, unknown or other
  modified_base (566)..(566): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccggnagagggtcaccatatcttgttctaggaaacngctccggcatctacaaactaaactattttgctggtaccagcaattcccaggactccggcccccactcctcatctaatagaaatgatcacgtccggcccgtccggggtccctgaccccgtattctcgtcggcctccatcgtctcggcctacctcacgccctccctgaccatcgaggtcggcctccgggtcgaggagtgaggctagtaattagttacgtgtcgacgacggtggaatcgaactntccgtaggtaacgtcgggtccggtggttccggggacggacgggaccaggttcgttcggaccgtctaagccgacggcccgaggtccnccgtccccg

SEQ ID NO: 411123 - DNA, 567 bp, Homo sapiens
  misc_feature: GZ8MTXP01ADXC5.17.28.C06.1.454.CMB.2.raw
  modified_base (378)..(378): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctgggggtccctgagactctcctgtgcagcctccggattccccttcagtagttatggatgacttgggtccgccagactccgaggggaaggggctgggagtgggtggccaacataaagcaagatggaactgccccgtagttttacgnggactcgtgtgaagggtccgtttcacatctccagacgacaacgccaaagaattcactgtatctacaactgaacagcctgggagagtcgcagacacggccgtgtattactgtgcgaagattggtaaggaaaaagtagtggcttggttgtttaagtgggggccagggggacgccccgtggttcctaacccg

SEQ ID NO: 411124 - DNA, 552 bp, Homo sapiens
  misc_feature: GZ8MTXP01ENEBG.17.28.C06.1.454.CMB.2.raw
  modified_base (378)..(378): a, c, t, g, unknown or other
  modified_base (508)..(508): a, c, t, g, unknown or other
  modified_base (534)..(534): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctgggggtccctgagactctcctgtgcagcctccggattccccttcagtagttatggatgacttgggtccgccagactccaggggaaggggctggagtgggtggccaacataaagcaaagatggaaactgccccgtagttttacgnggactctgtgaagggcctttcaccatctcagagacaacgccaagattcactgtatctacaactgaacagcctgggagagtcgcagacacggccgtagtattactgtgcgaagattgaggaaaagtatggnttgttgtttaatgggggccaggggcncccgtgggttctaacccg

SEQ ID NO: 411125 - DNA, 545 bp, Homo sapiens
  misc_feature: GZ8MTXP01C70GY.17.28.C06.1.454.CMB.2.raw
  modified_base (206)..(206): a, c, t, g, unknown or other
  modified_base (235)..(235): a, c, t, g, unknown or other
  modified_base (243)..(243): a, c, t, g, unknown or other
  modified_base (467)..(467): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggnagaggtcaccatatcttgttctggaaacngctccggnatctacaactaaactattttgctggtaccagcaaattcccaggactccggccccccgactcctcatctatagaaatgatcatccggccctccggggtccctgaccccgtattctctgctccatcgtctggccacctcacgccctccctcgaccatcgaggtcgggtccgtcccgggtccgaggagtgagtctagtattattacgtgtcgcaccgtgggatgacntcctgaatgggtcggtgttcgggcggaggaccgagcgttcgacccgtcgtaacgtcgacgcccgaggccttcgccccg

SEQ ID NO: 411126 - DNA, 610 bp, Homo sapiens
  misc_feature: GZ8MTXP01A5BAV.17.28.C06.1.454.CMB.2.raw
  modified_base (381)..(381): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggtgagtccggggagctggtccagcctgggggtcctgagactctcctgtgcagcctccggacttccccttcagttagttatggatgtacgttgggtccgcagactccgagggacggggctgggaggtgggtgaccaacaataaagcaaagataggaactggaccccgtagttttacgnggtactcgtagtaggaagggtccgtttccaccgatcctaccagacacaacgaccaaagtacttcactagtactactaacaactagaacagcctgggaagagtcgacgagacgaccggcgttgtaattacgtgtgcgaagtgttaggtaaaggaaaacgtaggtggcgttggttggtttaaggttcgggggaaccctagggggaccttcccggtaaggttccgtaacccg

SEQ ID NO: 411127 - DNA, 581 bp, Homo sapiens
  misc_feature: GZ8MTXP01DJVAK.17.28.C06.1.454.CMB.2.raw
  modified_base (371)..(371): a, c, t, g, unknown or other
  modified_base (493)..(493): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggagcctggtccagctgggggtccctgagactctcctgtgcagcctccggattccccttcagtagttatggatgacttgggtccgccagactccagggaaggggctggagtgggtggccaacataaagcaagatggaactgccccgagttttacgnggactctgtgaagggccgtttcaccatctcagagacaacgccaaagaattcaactgtatctacaactgaaacagccctgggagaggtcgcaagccaacggccgtagtattactgtgcgaagnttaggtaaaggaaaaagtaaagtgggacgttggttagttttaagttgggggccgtaaggggacgccccgttgggttccctaaccccgg

SEQ ID NO: 411128 - DNA, 585 bp, Homo sapiens
  misc_feature: GZ8MTXP01DN62L.17.28.C06.1.454.CMB.2.raw
  modified_base (300)..(300): a, c, t, g, unknown or other
  modified_base (366)..(366): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagcctggtccagctgggggtccctgagactctcctgtgcagccctccggattccccttcagtagttatggatgacttgggtccncagactcgagggagggctggagtggtgcaacataaagcaagatggaactgccccgtagttttacgnggactcgtagtgaagggtcctttcacctatctccagacgacaacgccaaagaattcaactagtatctacaactagaacagccctagggagagtcgacgagaccgacggccgtagtacttactgtgcgaagagttggtaaggaaaaagttaagtggttacgttggttaggttttaagtgggggtccgaggggacgttcccgttcgggttccgtaaccccg

SEQ ID NO: 411129 - DNA, 634 bp, Homo sapiens
  misc_feature: GZ8MTXP01D024H.17.28.C06.1.454.CMB.2.raw
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcgagggtcctgggcccagtctgtgctgactcagcccaccctcagtgtcgtcgggaccccggcaggaggtcacatatcttgttctaggaaacagcctccggcatctacaaactaaactattttgctaggtaccagcaacttcccgaggactcccggcccccgactcctcatactaataagaaatgatcacgtccggccccgttccggggccctacgaccccgtacttctcgtcggtcctaccctattcgtctcgggccctacctccgacgtcccctaccctcgacctatcgacggtcgggccgtcccgggtccgaggtagtggacggtctagtaatttacgttacgtgtcgacgaccggtggactcgaactactccgtagtaacggttgggtccgggttgggttccgggcgggacgggaccgagggttccgttcggacccgttcgtaaacggtccgacggacccgaaggtcccgttcccgtcccccgg

SEQ ID NO: 411130 - DNA, 556 bp, Homo sapiens
  misc_feature: GZ8MTXP01DVD5P.17.28.C06.1.454.CMB.2.raw
  modified_base (376)..(376): a, c, t, g, unknown or other
  modified_base (458)..(458): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggagcctggtccagcctgggggtccctgagactctcctgtgcagcctccggattccccttcagtagttatggatgacttgggtccgccagactccgagggaggggctgggagtgggtggccaacataaagcaagatggaactgccccgtagttttacgnggactctgtgaagggccgtttcacctatctccagagacaacgccaagaatcactgtatctacaactagaacagcctggacgngtcgcagacacggccgtagtattactgtcgcgaagattggtaggaaaagtaagtggagttgttgtttgtggggcctaggggcgcctgggttctaaccg

SEQ ID NO: 411131 - DNA, 589 bp, Homo sapiens
  misc_feature: GZ8MTXP01BV6HB.17.28.C06.1.454.CMB.2.raw
  modified_base (206)..(206): a, c, t, g, unknown or other
  modified_base (236)..(236): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggaccccggnagagggtcaccatatcttgttctggaaacngctccggcatctacaactaaactattttgctggtaccagcaattcccaggactccggccccccgactcctcatctatagaaatgatcatccggccctccggggtccctgaccccgattctcgtcggcctccatgtctggcaccctcacgccctccctcgaccatcaggtcgggcctcccgggtccgaggactggacggctgtatttagttactggttgccgtaaccggtgggatggactagtccgtagtaagttcgggtccggtgggttccgggcgggttacgggaccgagggttccgttcggacccgtccgtaagtcccgacggccccgaaggtcccgttccggtccccccg

SEQ ID NO: 411132 - DNA, 492 bp, Homo sapiens
  misc_feature: GZ8MTXP01B6YQJ.17.28.C06.1.454.CMB.2.raw
  modified_base (364)..(364): a, c, t, g, unknown or other
  modified_base (426)..(426): a, c, t, g, unknown or other
  modified_base (489)..(490): a, c, t, g, unknown or other
  modified_base (492)..(492): a, c, t, g, unknown or other
tcagcgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatccggcccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacntcctgaatgggtcgtgttcggcggaggaccaggctcgaccgtcctaaagtcagcccaaggcncgcccctcggtcactctccgttcccaccctcctcctgtcctacgctgagcggctggcagcganngn

SEQ ID NO: 411133 - DNA, 594 bp, Homo sapiens
  misc_feature: GZ8MTXP01DXT6Y.17.28.C06.1.454.CMB.2.raw
  modified_base (209)..(209): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtcgtcggggacccccgggnagagggtcaccatatcttgttctggaaacagctccggcatctacaaactaaactatttttgctggtaccagcaattcccaggactccggccccccactccctcatctaataagaaatgatcatccggccccgtccggggtccctgaccgtacttctctcgctccaatcgtcgtggccacctcacgccctccctagacccatcgaggtcgggcctccgggtaccgaggatcggagctgtaatttattacgtgtcgcctacggtgggactgactatcctaggtaagtcgggtccggtggttcgggcgggaacgggacccgaggtccttcggacccgttaccgtaagtccgaacgccccgaagggttccctcccggcccccgttccgg

SEQ ID NO: 411134 - DNA, 580 bp, Homo sapiens
  misc_feature: GZ8MTXP01A8YV8.17.28.C06.1.454.CMB.2.raw
  modified_base (236)..(236): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggcagaggtcaccatatcttgttctggaaacngctccggcatctcaactaaactattttgctggtaccagcaattcccaggactccggccccccgactccctcatctaataagaaatgatcactccggccccttccgggggtccctgaccgtacttctctcggcctccaatcgtctggccaccctcacgccctcctcgaccatcagtcgggctccggtcgaggatgaggctgatttattacgtgtgcgaccgtgggatgactacgtcctagaacgttcgggtccgggtggttccggggcgggaggggacccgagggtccttacgggacccgttacctaaggtccaacggcccgaagggcctccggcccccgttcgg

SEQ ID NO: 411135 - DNA, 540 bp, Homo sapiens
  misc_feature: GZ8MTXP01EXJTB.17.28.C06.1.454.CMB.2.raw
  modified_base (497)..(497): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaaattcccaggatccggccccccgactcctcatctatagaaatgatcatcggcccctccggggtccctcgaccgattcctctggcctccaattgtctggcaccctcacgccctcctgacccatcagtgggcctccggtccgaggatgaggctgtattattacgtgtgcaccgtgggatgacatcctgaatggtccggtgttcgggcgggagggaccgaggcnggccgttcctaaggtcaaggcccaagggctcgcccccgtccgg

SEQ ID NO: 411136 - DNA, 638 bp, Homo sapiens
  misc_feature: GZ8MTXP01A6R0B.17.28.C06.1.454.CMB.2.raw
  modified_base (208)..(208): a, c, t, g, unknown or other
  modified_base (238)..(238): a, c, t, g, unknown or other
  modified_base (432)..(432): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcggggacccccgggnagagggtcaccatatcttgttctggaaacngctccggcatctacaactaaactattttgctggaccagcaattcccaggactccggcccccactcctcatctatagaaatgatcatccggccctcccggggtcctcgaccgacttctcgtcggcctccaatcgtctacggcctacctcacgccctccctagacccatcgaggtcgggcctcccgggtccgaggntggacggtctagtatttacgtacgtggtcgccgaacccggttggggactaggtacctaagttcccgttaaggtaacgttcggggttcccgggttcggggttcgggaccgggggaacggggaccccgaagggtccttacggttacccggttacccttaaaggcccgaacggaccccgaaggttcccgtcccggaaccccccgttcgg

SEQ ID NO: 411137 - DNA, 555 bp, Homo sapiens
  misc_feature: GZ8MTXP01CY3TB.17.28.C06.1.454.CMB.2.raw
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggcagagggtcaccatatcttgttctggaaacagctccggcatctcaactaacatttttgctggtaccagcaattcccaggactccggccccccgactcctcatctatagaaatgatcatccggcccctccggggtccctgaccccgattctctggctcccatcgtctggcacctcacgccctccctgaccatccagtcgggcctccgggtccgaggactggacggctagtatttagttactgtcgcgaccggtggactgacatcctagatgggtccggtgttccgggcggacgggaccgagggcgttcggaccgttccgtaagtccaggcccaaggccgttccgtcccccg

SEQ ID NO: 411138 - DNA, 559 bp, Homo sapiens
  misc_feature: GZ8MTXP01CINXG.17.28.C06.1.454.CMB.2.raw
  modified_base (237)..(237): a, c, t, g, unknown or other
  modified_base (509)..(509): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggcagagggtcaccatatcttgttctggaaacngctccggcatctacaactaaactatttttgctggtaccagcaattcccaggactccggccccccactcctcatctaatagaaatgatcagtccggccctcggggtccctgacccccgattctctggcctccatcgtctggccacctcacgccctccctgaccatcgaggtcgggctccggtccgaggactgagctgtatttagttactgtcgacgaccggtgggatgactatcctggtaactcgggtccggtggttcgggcgggaggaccgnggcgttcggacccgtctaacgtcacgcccgaggtccgttccggtcccccg

SEQ ID NO: 411139 - DNA, 555 bp, Homo sapiens
  misc_feature: GZ8MTXP01DXZJK.17.28.C06.1.454.CMB.2.raw
  modified_base (375)..(375): a, c, t, g, unknown or other
  modified_base (397)..(397): a, c, t, g, unknown or other
  modified_base (516)..(516): a, c, t, g, unknown or other
  modified_base (543)..(543): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattcccctcagtagttatggatgacttgggtccgccagactccagggaaggggctggagtgggtggccaaacataaaagcaaagatggaactgccccgagttttacgnggactctgtgaagggccgtttnacccatctcagagacaaacgccaaagaattcaactgtatctaacaactgaaacagcctggagagtcgcagacacggccgtagtattactgtgcgaagattgtaggaaaaagtatcgggnttgttgtttaagtggggcctagggacncctggctaaccg

SEQ ID NO: 411140 - DNA, 559 bp, Homo sapiens
  misc_feature: GZ8MTXP01DAY19.17.28.C06.1.454.CMB.2.raw
  modified_base (205)..(205): a, c, t, g, unknown or other
  modified_base (233)..(233): a, c, t, g, unknown or other
  modified_base (397)..(397): a, c, t, g, unknown or other
  modified_base (400)..(400): a, c, t, g, unknown or other
  modified_base (425)..(425): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccacctcagtgtctcgggaccccggnagaggtcacatatcttgtctaggaaacngctccggcatctacaaactaaactatttttgctggtaaccagcaaattcccgaggactccggcccccgatcctcatctatagaaatgatcacgtccggcccgtccggggtcctcgaccccgtattctctcggctcccatcgtctgccacctcacgcctacccgnacntcgaggtcggccgtccggacgaganggagtgtagtattagttacgtgtcgacgacgtggtagtagtactactcgtacgtacgtcggtcggtcggttcgggtcggacgggacgacgcgcgaccgtaacgtacgtaacgacgaccgacgtccgccgtcccg

SEQ ID NO: 411141 - DNA, 555 bp, Homo sapiens
  misc_feature: GZ8MTXP01D14TY.17.28.C06.1.454.CMB.2.raw
  modified_base (483)..(483): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggaccccggcagagggtcacatatcttgtctgaaacagctccggcatctacaaactaaactattttgctggtaaccagcaaacttcccaggactccggccccccgactcctcatctaatagaaatgatcatccggccctccggggtccctcgaccccgtattctcgtcggcctacccatcggtctcgggcctacctcacggtccctccctagacctaatcgaggtcgggctcccgggtaccggaggatggaggctgaactttagttactgtcgcgacgtggatgactntcctagagtgggtccggtgttcggcgggaggaccgaggcgttgaccgtctaagcagccaggccttcgccccg

SEQ ID NO: 411142 - DNA, 570 bp, Homo sapiens
  misc_feature: GZ8MTXP01EVKEH.17.28.C06.1.454.CMB.2.raw
  modified_base (278)..(278): a, c, t, g, unknown or other
  modified_base (339)..(339): a, c, t, g, unknown or other
  modified_base (374)..(374): a, c, t, g, unknown or other
  modified_base (518)..(518): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtccagtgtgaggtccagttggttgagtccggggagcctggtccagccgtgggggtccctgagactctcctgtgcagccctccggattccccttnagtagttatggatgacttgggtccgcagactccgaggggaggggctggagtgggtgccaanataaagcaagatggaactgccccgtagttttacgnggactcgtgtgaagggtccgtttcaccatcctcagagacaacgccaagattcacttgtatctacaactgaacagcctaggagagtcgcagacacggcgtagtacttactgtgcgaagtagttggtaaaggaaaagtaagtcggngttggttaggtttaagtgggggccgaggggagccccgtgggttcctaacccg

SEQ ID NO: 411143 - DNA, 559 bp, Homo sapiens
  misc_feature: GZ8MTXP01BVGNM.17.28.C06.1.454.CMB.2.raw
  modified_base (207)..(207): a, c, t, g, unknown or other
  modified_base (505)..(505): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccggnagagggtcaccatatcttgttctggaaacagctccggcatctacaaactaaactattttgctggtaccagcaattcccaggactcccggccccccgactccctcatctaatagaaatgatcactccggccccgtccgggtctctcgaccccgtattctcgtggcctaccatgtctggccacctcacgccctccctgaccatcagtcggctccggtcgagactgagctagtattagttctgtcgcaccggtggatgactatcctagtacgtggtccggtggttcgggacggagggacgnggccgttgaccccgtaacgtaacgtcgacgtacccgagggtccttccgtccccg

SEQ ID NO: 411144 - DNA, 580 bp, Homo sapiens
  misc_feature: GZ8MTXP01ADHGF.17.28.C06.1.454.CMB.2.raw
  modified_base (205)..(205): a, c, t, g, unknown or other
  modified_base (235)..(235): a, c, t, g, unknown or other
  modified_base (243)..(243): a, c, t, g, unknown or other
  modified_base (459)..(459): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggnagagggtcaccatatcttgttctggaaacngctccggnatctacaactaactatttttgctggtaccagcaaattccccaggactccggcccccccgactccctcatctaatagaaatgatcagtcggcccctccgggggtccctgaccgattcctctggcctccaatcgtctggccacctcacgtcctcccctgaccatcagtcgggcctccggtaccgagatgaggctgattactagtgtgccaccggtggntgacatccgtgaacgtcgggtccggtggttcgggcgggacggggaccgtagggcttcggcccgttaccgtaaacggtcgaaccgtacccgaacgggttccctcggttccccccgttccggg

SEQ ID NO: 411145 - DNA, 613 bp, Homo sapiens
  misc_feature: GZ8MTXP01D7QLK.17.28.C06.1.454.CMB.2.raw
  modified_base (341)..(341): a, c, t, g, unknown or other
  modified_base (380)..(380): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtcagtgtgagtcagttggtgagtcggggagctggtccagccgtgggggtccctgagactctcctgtgcagcctccggattccccttcagtagttatggatgacttgggtccgccagactccgaaggggaagggggctgggaggtggggtgaccaanataaaagcaaagatggaaactgaccccgtagttttacgngactctgtagaagggtcctttcacctatcctccagacacaacgacaaagattcacttagtatctaacaactagaaacagtcctagggaagacggtccgacaagaaccgaccgggcgttagtaattacctggtgcggaagtattagggtaaaggttaaaaaagttacgtgggttagttggttagttttaaggtcggggtccagggggtacgttccccgtgggttccctaacccg

SEQ ID NO: 411146 - DNA, 575 bp, Homo sapiens
  misc_feature: GZ8MTXP01AEFEL.17.28.C06.1.454.CMB.2.raw
  modified_base (277)..(277): a, c, t, g, unknown or other
  modified_base (337)..(337): a, c, t, g, unknown or other
  modified_base (370)..(370): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagccgtgggggtccctgagactctcctgtgcagcctccggattcccctnagtagttatggatgacttgggtccgcagactccgagggaggggctggagtgggtgccaanataaagcaagatggaactgcccgtagtttacgnggactcgtgtaggaagggtccgtttacaccatctccagacgacaacgccaaagattcactgtatctaacaactgaacagcctggagagtcgacagaccacggccgtagtattacgtgtgcgtaagattaggtaggaaaaagttagtgggcgttggttggtttaagttcgggggcctaggggacgttcccgtgggttcctaacccg

SEQ ID NO: 411147 - DNA, 576 bp, Homo sapiens
  misc_feature: GZ8MTXP01EH0V5.17.28.C06.1.454.CMB.2.raw
  modified_base (206)..(206): a, c, t, g, unknown or other
  modified_base (233)..(233): a, c, t, g, unknown or other
  modified_base (395)..(395): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggnagaggtcaccatatcttgtctgaaacngctccggcatctacaactaaactattttgctggtaccagcaaattcccaggactccggccccccgatccctcatctatagaaatgatcagtccggccccgtccggggtccctgaccccgtattctctggcctccatcgtctggccacctcacgcccttcccngaccatcgagtcgggctccgggtcgaggatggagctagtattagttactgtcgcgtaccggtggactgaacagtcctagtaacgtcgggtccggttggttccggggcgggaacgggacccgagggccgttcggacccgtccgtaaagtccgacggccccaagggtcccttccggtcccccg

SEQ ID NO: 411148 - DNA, 629 bp, Homo sapiens
  misc_feature: GZ8MTXP01CKUY4.17.28.C06.1.454.CMB.2.raw
  modified_base (240)..(240): a, c, t, g, unknown or other
  modified_base (323)..(323): a, c, t, g, unknown or other
  modified_base (363)..(363): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccgggcagagggtcaccatatcttgttctaggaaacngctccggcatctacaaactaaactatttttgctggtaccagccaattcccaggactcccggcccccgactcctcatctaatanaaatgatcacgtccggcccgtccggggtcctgaccccgtnttctcgtcgcctccatcgtctcggcctacctcacgtccctccctgacctatcgaggtcgggcctccgggtccgaggagtgagctagtatttacgttactggtcgcgtaccggtgggatcggactacgtccgtagtaacgttcggggttaaccggttgggttccggggacgggacgggaacccgtggggttacccgttcggaccccgttaacccgtaaaggtcccgaacggccccgttaacgggtccccgttccccggtccccccgg

SEQ ID NO: 411149 - DNA, 488 bp, Homo sapiens
  misc_feature: GZ8MTXP01DW6C1.17.28.C06.1.454.CMB.2.raw
  modified_base (270)..(270): a, c, t, g, unknown or other
  modified_base (336)..(336): a, c, t, g, unknown or other
  modified_base (362)..(362): a, c, t, g, unknown or other
  modified_base (379)..(379): a, c, t, g, unknown or other
  modified_base (390)..(390): a, c, t, g, unknown or other
  modified_base (480)..(488): a, c, t, g, unknown or other
tcagcgtagactagcacgaccggtgctcgatttagagctcacgtattgggtttgggggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggcccccccgactcctcatctatagaaatgatcatcggccctcggggtccctgaccgattcnctggctccatgtctggcacctcagcctccctgaccatcagtggctcggtcgaggatgagctgattntactgtgcacgtgggatgaacatccngaatggtccgtgtcggnggaggccagcngaccgtctaagtcagcccaggctcgcccctgtcacgtctcgttcccaccctcctcctacgtctacgctgagcgggctggcaggcgcatgnnnnnnnnn

SEQ ID NO: 411150 - DNA, 514 bp, Homo sapiens
  misc_feature: GZ8MTXP01CW2PK.17.28.C06.1.454.CMB.2.raw
  modified_base (365)..(365): a, c, t, g, unknown or other
  modified_base (499)..(499): a, c, t, g, unknown or other
  modified_base (504)..(514): a, c, t, g, unknown or other
tcagcgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatccggccccccgactcctcatctatagaaatgatcatcggcccctccggggtccctgaccgattctctggctccatgtctggcacctcagccctcctgaccatcagtcgggctccggtcgaggatgaggctgattatactgtgcacggtgggatgacntcctagaattgggtccggtgttcgggcggagggacaggctggaccgtcaagtcacgcccaaggctcgccccctcggcactctcgttccccgccctccctcctagtcctacgctgcgcgggctggcaaggcgacnttagnnnnnnnnnnn

SEQ ID NO: 411151 - DNA, 577 bp, Homo sapiens
  misc_feature: GZ8MTXP01C0OIT.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagtgtttgagtccggggagcctggtccagcctgggggtccctgagactctcctgtgcagccctccggattccccttcagtagttatggatgacttgggtccgcagactccgagggaaggggctggagtgggtggccaacataaagcaagatggaactgccccgtagttttacgtggactcgtgtgaagggtccgtttcaccatctccagacgacaacgccaagaatcactgtatctacaactgaacagcctagggagacgtcgacgacgacacggccgttgtattactgtgcgaagtattaggtaggaaaaagtaagtgggttacgttggttgttttaagttgggggccaggggtacgcccgttggttccgtaacccg

SEQ ID NO: 411152 - DNA, 566 bp, Homo sapiens
  misc_feature: GZ8MTXP01E17FI.17.28.C06.1.454.CMB.2.raw
  modified_base (273)..(273): a, c, t, g, unknown or other
  modified_base (330)..(330): a, c, t, g, unknown or other
  modified_base (370)..(370): a, c, t, g, unknown or other
  modified_base (463)..(463): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggttgagtccggggagccgtcagcctgggggtccctgagactctcctgtgcagcctccggacttcccctnagtagttatggatgacttgggtccgccagactccgaggggaaggggctggagttggnggccaacataaagcaagatggaactaccgagttttaccgnggactcgtgtgaaagggcctttcaccatctccagacgacaacgccaaagaattcactgtatactaacaactgaacagcctagagaggtccganaacgaccgacggccgttgtattacgtgtgcgagagtgtaaggaaaagtacttggcttgttgtttagttcggggcagggcgcccgtggcctaaccgttctcccg

SEQ ID NO: 411153 - DNA, 604 bp, Homo sapiens
  misc_feature: GZ8MTXP01CO5IU.17.28.C06.1.454.CMB.2.raw
  modified_base (208)..(208): a, c, t, g, unknown or other
  modified_base (238)..(238): a, c, t, g, unknown or other
  modified_base (480)..(480): a, c, t, g, unknown or other
  modified_base (488)..(488): a, c, t, g, unknown or other
  modified_base (538)..(538): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccggnagagggtcaccatatcttgttctggaaacngctccggcatctacaactaaactatttttgctggtaccagcaattcccaggactccggccccccactcctcatctaatagaaatgatcagtccggccccgtccggggtccctgacccccgtattctcgtcggcctcccatcgtctcggcctacctcacgtccctccctgacccatcgagtcgggcctccgggtccgaggactggacgtctagtaactttagttactggtcgcgaccggtggnttgaactntccgtagaacgttcgggtcccgggttggttcggggcggacggggaacccngggttccgttcggacccgttaacgtaacggtccgacgaccccgaagggtcccttccggtccccccg

SEQ ID NO: 411154 - DNA, 613 bp, Homo sapiens
  misc_feature: GZ8MTXP01DA0QR.17.28.C06.1.454.CMB.2.raw
  modified_base (205)..(205): a, c, t, g, unknown or other
  modified_base (235)..(235): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctaaccctcctcactcactgtgcagggtcctgggcccagtctgtgctgactcagccaccctcagtgtctgggacccccggnagagggtcaccatatcttgttctggaaacngctccggcatctacaaactaaactatttttgctgtacagcaacttcccaggactccggccccccatcctcatctatagaaatgatcactcggccctccggggtcctgaccgtacttcctctggctccatcgtctggccacctcacgccctcctcgaccatcaggtcgggctccggtccgagtagtgaggctagtattagttacgtggtacgtcgtaaccggttgggaactcgaactacgtttacccgtaggtaagttcggggttcccgggttcgggtttcggggaccggggttaacgggacccgcgggtaccgtcgttaacccgttcttaaaccggtcaacgccccgaaggtcccgttccgtcccccgttcggtcccc

SEQ ID NO: 411155 - DNA, 570 bp, Homo sapiens
  misc_feature: GZ8MTXP01AM0EN.17.28.C06.1.454.CMB.2.raw
  modified_base (206)..(206): a, c, t, g, unknown or other
  modified_base (236)..(236): a, c, t, g, unknown or other
  modified_base (465)..(465): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggnagagggtcaccatatcttgttctggaaacngctccggcatctacaaactaaactatttttgctggtaccagcaacttccccaggactcccggccccccgactcctcatctatagaaatgatcatccggccctcccggggtccctgacccccgattctctcggctccatgtctaggcacctcacgccctaccctgaccatcaggtcgggcgtcccgggtccgaggactgacggctagtattattactgtgcgaccgtggntgacatcctagagtcggtccggtggttccggcgggacgggacccgaggcgttcgacccgttaaccgtaaggtccaacggcccgaacgggccttccggtccccccg

SEQ ID NO: 411156 - DNA, 621 bp, Homo sapiens
  misc_feature: GZ8MTXP01A2OR9.17.28.C06.1.454.CMB.2.raw
  modified_base (206)..(206): a, c, t, g, unknown or other
  modified_base (236)..(236): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggnagagggtcaccatatcttgttctggaaacngctccggcatctcaactaaactatttttgctggtaccagcaattcccaggactccggcccccgactcctcatctatagaaatgatcatccggcccctccggggtccctgacccccgtattctcgtggcctaccatcgtctggccacccgtcacgccctccctgacccatccgaggtcggggtccttcccggggtccgaggacgttcggaagtcttagtaactttagttacgtggttcgaccgtaaccgggttgggaatggacctagttcccgtagtaacgttcggggtccggttggttccggggacgggacggacccgtaggccgttcggacccgttaaccgtaagtccgacggccccggttaaggtcccgttccgggccccccg

SEQ ID NO: 411157 - DNA, 657 bp, Homo sapiens
  misc_feature: GZ8MTXP01A9M7Q.17.28.C06.1.454.CMB.2.raw
  modified_base (217)..(217): a, c, t, g, unknown or other
  modified_base (251)..(251): a, c, t, g, unknown or other
  modified_base (258)..(258): a, c, t, g, unknown or other
  modified_base (580)..(580): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcgacgggtccgtcgggcccagtctgtgctgactcacgcccaccctcagtcgtcgtccggggacccccgggnaggacgggtccaccatatcttgttctaggaaacngctccgnatctacaactaactatttgctggacagcaactccaggactcccggcccccactcctcactctaataagaaatgactcacgtccggtccctccgtcgggtccctcgtaccccgtacttctcgtcggcctcccattcgtctcggccacctcacgtccctccctgaccatcgaggtcggccgtccgggtacgaggacgtggacggtctagttaatttacggttacgtggttacgacgtaaccggttgggacttcggaacctacttccgtaggtaacggttcgggggtcccggttgggttccgggggaccgggacgggtaacccgngggttccgttcggaaccccggttaaccgttaacgtccgaacggccccgttaagggtccccgttcccggtccccccgg

SEQ ID NO: 411158 - DNA, 592 bp, Homo sapiens
  misc_feature: GZ8MTXP01D5MWM.17.28.C06.1.454.CMB.2.raw
  modified_base (383)..(383): a, c, t, g, unknown or other
  modified_base (419)..(419): a, c, t, g, unknown or other
  modified_base (475)..(475): a, c, t, g, unknown or other
  modified_base (499)..(499): a, c, t, g, unknown or other
  modified_base (531)..(531): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagcctggtccagccgtgggggtccctgagactctcctgtgcagccctccggattccccttcagtagttatggatgacgttgggtccgccagactccgaggggaaggggctgggaggtgggtgaccaaacataaagcaaagatggaactggacccgtagttttacgnggactcgtgtgaagggcctttcaccatctaccaganacaacgccaagattcacttagtactactacaactgaacagcctagggagagtcganagaccacggccgttagtattacgngtgcgaagattggtaaaggaaaagtaagtggngttggttaggtttaaggttcgggggaaccaaggggtcgcccgttcggttccgtaaccccgg

SEQ ID NO: 411159 - DNA, 558 bp, Homo sapiens
  misc_feature: GZ8MTXP01C3RA1.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggagcctgtccagctgggggtccctgagactctcctgtgcagccctccggattccccttcagtagttatggatgacttgggtccgccagactccgagggaaggggctggagtgggtggccaacataaagcaagatggaactgccccgtagttttacgtggactctgtgaagggccgtttcaccatctccagagacaacgccaaagattcactgtatctacaactgaacagcctggagagtcgcagacacggccgtgtattactgtgcgaagattggtaaggaaaagtaagtggcttgttaggttttaagttgggggccgaggggacgcccgtgggttctaacg

SEQ ID NO: 411160 - DNA, 733 bp, Homo sapiens
  misc_feature: GZ8MTXP01DF20Z.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgagtcagttggtgagtcggggagctgtccagctgggggtccctgagactctcctgtgcagcctccggattccccttcagtagttatggatgacttgggtccgccagactccgaggggaaggggctggaggtgggtgaccaaacataaaagcaaagagtaggaactggaccccgtaggtttttacgtggtacttcgtaggttaggaacggggtcccgttttacaaccctacttcctaccgaagaacgaacccaaacggacccaaagtaaactttaccgaacttacggttaacttacttaaccaaaccgttacgaaaccacgtaccccttaggggacggtaaggttcccgaccgaacggaacccgaccgggtacccggtttagttaacgtttaccgtggttcggacggtaagtaagttagggttaaaagggaaaaaacggttaagtcggggttcgtttgggtttagggtttttaacggttacggggggtccccgtaaggggggtaccgttccccgggtttaagggttccccgttaaccccgg

SEQ ID NO: 411161 - DNA, 595 bp, Homo sapiens
  misc_feature: GZ8MTXP01BUH37.17.28.C06.1.454.CMB.2.raw
  modified_base (279)..(279): a, c, t, g, unknown or other
  modified_base (304)..(304): a, c, t, g, unknown or other
  modified_base (344)..(344): a, c, t, g, unknown or other
  modified_base (378)..(378): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagccgtgggggtccctgagactctcctgtgcagccctccggattccccttnagtagttatggatgacttgggtccnccagactccgaggggaaggggctgggagtgggtgaccaanataaagcaagatggaactgcccgtagttttacgnggactcgtagtgaagggtcctttcaccatctcagacacaacgccaagattcatagtatactaacaactgaacagcctgggagagtcgacagacaccggcgtagtattcgtgtcgcgaagagttaggtaaaggaaaaagttagtggttacgttggttaggttttaaggttcgggggaacccgtagggggtaccgccccgttgggttccctaaccccgg

SEQ ID NO: 411162 - DNA, 556 bp, Homo sapiens
  misc_feature: GZ8MTXP01DQ3WD.17.28.C06.1.454.CMB.2.raw
  modified_base (299)..(299): a, c, t, g, unknown or other
  modified_base (369)..(369): a, c, t, g, unknown or other
  modified_base (391)..(391): a, c, t, g, unknown or other
  modified_base (439)..(439): a, c, t, g, unknown or other
  modified_base (504)..(504): a, c, t, g, unknown or other
  modified_base (535)..(535): a, c, t, g, unknown or other
  modified_base (549)..(549): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattccccttcagtagttattggatgacttgggtccnccagactccagggaaggggctggagtgggtggccaacataaagcaagatggaactgccgtagttttacgnggactctgtgaagggccgtttnaccatctccagagacaacgcaagattcactgtatctacaactgaaacngcctgaggagtcgcagacacggccgtgtattactgtgcgagaatgttaggaaaaagttagtcggnttggttgtttagttgggggccaagggggacnccccgttgggtccnccgttcc

SEQ ID NO: 411163 - DNA, 591 bp, Homo sapiens
  misc_feature: GZ8MTXP01AZHLK.17.28.C06.1.454.CMB.2.raw
  modified_base (373)..(373): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtccagtgtgaggtccagttggtgagtcggggagctggtccagcgtgggggtccctgagactctcctgtgcagccctccggacttcccctcagtagttatggatgacttgggtccgccagactccgagggaaggggctgggagtgggtgccaacataaagcaagatggaactgaccccgtagttttacgnggactctgtgaagggtcctttcaccatctccagacgacaacgaccaaagaactacactagtatactaacaactagaacagaccctagggagagtcgacgaagaccgaccgggtccgtagtattacgtgtgacgaagtaagttggtaaaggaaaagtagtggttgttggttagtttaaggtggggccgtaggggaccgttccgtcggttccgtaacccg

SEQ ID NO: 411164 - DNA, 593 bp, Homo sapiens
  misc_feature: GZ8MTXP01A8DRR.17.28.C06.1.454.CMB.2.raw
  modified_base (379)..(379): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattccccttcagtagttatggatgacttgggtccgcagactccgagggaaggggctgggagtggggtggccaaacataaagcaaagatggaactggcccgtaggttttacgnggactcgtaggtgaaggggtcccgtttcaccatcctcagagacaacgaccaaagaattcacttagtacttctaacaactagaaacagccctaggagagtcgcgagacacggccgtagtattactggtgcgaagagttggtaaggaaaaagtagtgggacgttggttgtttaagtgggggccgagggggacgttccccgtgggttccgtaacccg

SEQ ID NO: 411165 - DNA, 493 bp, Homo sapiens
  misc_feature: GZ8MTXP01EV8MQ.17.28.C06.1.454.CMB.2.raw
  modified_base (265)..(265): a, c, t, g, unknown or other
  modified_base (341)..(341): a, c, t, g, unknown or other
  modified_base (440)..(440): a, c, t, g, unknown or other
  modified_base (469)..(469): a, c, t, g, unknown or other
  modified_base (485)..(485): a, c, t, g, unknown or other
  modified_base (487)..(493): a, c, t, g, unknown or other
tcagcgtagactagcacgaccggtgctcgatttagagctcacgtattgggtttgggggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgatcctcatctatagaaatgatcatcgccctcgggtcctgaccgattcnctggctccatgctggcacctcacgcctccctgaccatcagtggctccggtcgaggatgaggctgattatactgtcncacgtggatgaacatcctgatggtccggtgtcgggcggagggacagctgaccgtctaagtcagcccaaggcctcgcccctgtccacgtctcggtccccnccctcctcctagtctacgctgagccgggntggcgaaggcgcatgngnnnnnnn

SEQ ID NO: 411166 - DNA, 573 bp, Homo sapiens
  misc_feature: GZ8MTXP01CP6F9.17.28.C06.1.454.CMB.2.raw
  modified_base (235)..(235): a, c, t, g, unknown or other
  modified_base (243)..(243): a, c, t, g, unknown or other
  modified_base (353)..(353): a, c, t, g, unknown or other
  modified_base (393)..(393): a, c, t, g, unknown or other
  modified_base (426)..(426): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggcagagggtcaccatatctgttctggaaacngctccggnatctacaactaacattttgctggtaccagcaattcccaggactccgccccccgatcctcatctatagaaatgatcactccgcccgtccggggtcctcgaccccgtattcncgttgcctaccatcgtctggccacctcacgtccctcccgntacccatcgagtcgggtcctccggtccgaaggngtagacgtctagtattacgttcgtgtcgacgtacgtggatcgactcgtccgtagtacgtcgggtccggtggttcggcgggacggacgtcggccgttcggacccgtaacgtacgtccgaccgtaccgacggtcccgttcccgtccccg

SEQ ID NO: 411167 - DNA, 692 bp, Homo sapiens
  misc_feature: GZ8MTXP01B3K5S.17.28.C06.1.454.CMB.2.raw
  modified_base (280)..(280): a, c, t, g, unknown or other
  modified_base (342)..(342): a, c, t, g, unknown or other
  modified_base (344)..(344): a, c, t, g, unknown or other
  modified_base (380)..(380): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagccgtgggggtccctgagactctcctgtgcagccctccggattccccttnagtattatggatgacttgggtcccgccagactccgagggaggggctggagtgggtgccaaananaaagcaaagatggaactgaccccgttagttttacgnggactcgtaggtagaacgggtccttacactactcctaccgaagaacgaaccaaccgaacccgtaaagtaacttaccaacttagttaactacctaaacgaaacgtacgaaacgaacgtaccgtacgggaaggacggtacgacgaacgaaccgaaccggtaccggttacgttaacgttaacgttacgtacggtacggtaaggtaaggttaaggttaaagggttaaaaaggtaaaagttaaggttacgttggtttaggtttaaggtttaggggtaacgggtacgggacggttacccggtccggttccgtaacccg

SEQ ID NO: 411168 - DNA, 582 bp, Homo sapiens
  misc_feature: GZ8MTXP01E2G3U.17.28.C06.1.454.CMB.2.raw
  modified_base (277)..(277): a, c, t, g, unknown or other
  modified_base (341)..(341): a, c, t, g, unknown or other
  modified_base (376)..(376): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagccgtgggggtcctgagactctcctgtgcagccctccggattcccctnagtattatggatgacttgggtccgcagactccgaggggaaggggctgggagtgggtggaccaanataaagcaagatggaactgccccgtagttttacgnggtactcgtagtgaagggtccgtttacaccatctccagagacaacgccaaagatcactagtactctacaactgaaacagcctagggagagtcgcaagacgacggccgtagtattactgtgcgaagagttggtaaaggaaaaagtataggcgttgttggtttaacgtgggggaacccagggggacgttcccgtgggttcctaacccg

SEQ ID NO: 411169 - DNA, 605 bp, Homo sapiens
  misc_feature: GZ8MTXP01DYDUU.17.28.C06.1.454.CMB.2.raw
  modified_base (276)..(276): a, c, t, g, unknown or other
  modified_base (301)..(301): a, c, t, g, unknown or other
  modified_base (376)..(376): a, c, t, g, unknown or other
  modified_base (514)..(514): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggagctggtccagcgtgggggtccctgagactctcctgtgcagccctccggattccccttnagtagttatggatgacttgggtccnccagactccgaggggaggggctgggagtgggtggaccaacataaagcaaagatggaactgcccgtagttttacgnggactcgtagtgaagggtccgtttcacctatctccagacacaacgccaagaattcactagtatctaacaactagaacagccctagggacgaggtcgacagaccgacgggtccgtagttacttacgtgtcggcgaagtnttagggtaagggaaaaaagttaagtgggttagttggttaggttttaaggttcgggggcctagggggacgttcccgttgggccgttaacccg

SEQ ID NO: 411170 - DNA, 703 bp, Homo sapiens
  misc_feature: GZ8MTXP01DVWKF.17.28.C06.1.454.CMB.2.raw
  modified_base (208)..(208): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctaaccctcctcactcactgtgcagggtcctgggcccagtctgtgctgactcagcccaccctcagtgtcgtcgggacccccggnagagggtcaccatatcttgttctggaaacagctccggcatctacaaactaaactattttgctggtaccagctaacttcccgaggactcccggacccccccgtactccctacatctaataagaaatgatcacgtccggccccgtccgggtccctgaccgtattccctctcggcctccatcgtctcggcctaccctcaccgtcccctccctcgaacccacgttacgacgggttcggggtcccgttcccggggtcccggtaagggtacgttaggacgggtaccttagttaacgtttaactttaaccgttcggggtacggtaccggtaccgggtacggggtatacggaactacgttaccgtaggtaacgggtttcggggttcccgggttggggttcggggacggggacggggtacccgacgggtcgtaccggttacccggttccgttaacggtccaccggaaccgtaccggtccgacccgtcccccgttcggttccccg

SEQ ID NO: 411171 - DNA, 653 bp, Homo sapiens
  misc_feature: GZ8MTXP01D5MOR.17.28.C06.1.454.CMB.2.raw
  modified_base (275)..(275): a, c, t, g, unknown or other
  modified_base (379)..(379): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtccagtgtgagtcagttggtgagtcggggagcctggtccagccgtgggggtccctgagactctcctgtgcagccctccggattcccccttnagtagttatggatgacttgggtccgcagactccgaaggggaaggggctgggagtgggtggacctaacataaagcaaagatggaaactgccccgtagttttacgnggtactcgtagtgaagggcctttcaccatcctcagacacaacacaagatcactagtactactacaactgaaacagcctagggagtacgtacgacgaacgaaccgaccgggaccgttaggttaactttaaccgtggttcgcggaagtaagttaagggtaaaggttaaaaaaaaggtaacgttaggggttacgtttgggtttaggttttaacgggttacgggggtaacccgtagggggaccggttccccgttaacgggggttcccttaaccccggg

SEQ ID NO: 411172 - DNA, 543 bp, Homo sapiens
  misc_feature: GZ8MTXP01EDMR4.17.28.C06.1.454.CMB.2.raw
  modified_base (235)..(235): a, c, t, g, unknown or other
  modified_base (448)..(448): a, c, t, g, unknown or other
  modified_base (500)..(500): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggaccccggcaggaggtcaccatatcttgtctgaaacngctcgcatctacaactaaactattttgctggtaccagcaacttcccgaggactccggcccccgatcctcatctaatagaaatgactcacgtccggcccctccggggtccctcgaccccgtattctcgtcggcctaccatgtctggccacctcacgcctcctgaccatcgagtcggctccgggtcgaggatgagctagtattagttactggtcncgacgtggatgactatccgtagacgtgggtccggtgttcgggcggaggaccnggcgttcgacccgtcaagtcacgcccaggtcccttcgcccccg

SEQ ID NO: 411173 - DNA, 645 bp, Homo sapiens
  misc_feature: GZ8MTXP01C793Y.17.28.C06.1.454.CMB.2.raw
  modified_base (207)..(207): a, c, t, g, unknown or other
  modified_base (236)..(236): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagcccaccctcagtgtcgtcgggaccccggnagaggtcaccatatcttgtctaggaaacngctcgcatctacaactaaactatttttgctggtaccagactaactcccaggactcccggccccccactccctcactactaataagaaatgactaccacgtccggccccgttcccgggggtccctgacccgtacttcctctcggccttcccaattcgtccgttcgggaccctacccgtacaccgtccccttcccctacgaccctatccgaggttcgggccgttcccgggaccgaggagtggaggtctagtatttagttacgtgtcgcgaccggtggtactgactactccgtagtaacgttcgggtcccgggttggttcgggcgggtacgggaaccgcggtcttacggttacccgttaccgttaagaccgaaccggacccgtaacgggttccctcccggcccccgttaacg

SEQ ID NO: 411174 - DNA, 540 bp, Homo sapiens
  misc_feature: GZ8MTXP01APTZE.17.28.C06.1.454.CMB.2.raw
  modified_base (206)..(206): a, c, t, g, unknown or other
  modified_base (236)..(236): a, c, t, g, unknown or other
  modified_base (244)..(244): a, c, t, g, unknown or other
  modified_base (432)..(432): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggnagagggtcaccatatcttgttctggaaacngctccggnatctcaactaaacattttgctggtaccagcaattcccaggactccggcccccgatcctcatctatagaaatgatcatccggccctccggggtcctgaccccgattctctggctccatgtctggcaccctcacgccctccctgaccatcagtggctccggtcgaggatgagctagtattagttactgtncgacgtggatgacatccgtagacgtcgggtccggtgttccgggcggttagggacccgtagggcgttcggaccgtcctaaggtccacgcccaggtccgttcgtcccccg

SEQ ID NO: 411175 - DNA, 653 bp, Homo sapiens
  misc_feature: GZ8MTXP01CDAYE.17.28.C06.1.454.CMB.2.raw
  modified_base (238)..(238): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtctcgggacccccggcagagggtcaccatatcttgttctggaaacngctccggcatctacaaactaaactatttttgctggtaccagctaacttcccgaggactcccggccccccgactcctcatctaataagaatgactcacgtccggccccgtccggggtccctagaccccgtacttctcgtcggcctacccattcgtctcgggacctacctcacgtccctccctcgacctatcaggtcgggccgtccgggtccgaggagtcgaggcttagactttaggttacgtgtcgccgtaccggtgggactggaactcgtccgtaggtaacgttcgggttccgggtggttccgggggacggggacggggaaccgtacgggttaccggttcggttaccccgggttaaccgtaacggttccgaaccgggtaccccgaaaccgggtccccgttccggtccccccccgg

SEQ ID NO: 411176 - DNA, 499 bp, Homo sapiens
  misc_feature: GZ8MTXP01DTU8P.17.28.C06.1.454.CMB.2.raw
  modified_base (487)..(487): a, c, t, g, unknown or other
  modified_base (489)..(499): a, c, t, g, unknown or other
tcagcgtagactagcacgaccggtgctcgatttagagctcacgtattgggtttgggggtgtggtggtctccactcccgcccagtctgtgctgactcagccaccctcagtgtctgggaccccgggcagagggtcaccatatcttgttctggaaacagctccggcatctcaactaaacatttttgctggtaccagcaattcccaggatcggccccccgatcctcatctatagaaatgatcatcggccctcggggtccctgaccgattctctggctcatgctggcacctcagccctccctgaccatcagtggctccggtcgagatgaggctgattatactgtcgcacgtggatgaacatcctgaatgggtccgtgttcgggcggagggacagctgaccgtccaagtcagcccaaggctcgccccctgtcacgtctcgtccccgccctctcctgtctacgctgacgcggcgtaaggcaaggcgacgaatgngnnnnnnnnnnn

SEQ ID NO: 411177 - DNA, 643 bp, Homo sapiens
  misc_feature: GZ8MTXP01D9I7Y.17.28.C06.1.454.CMB.2.raw
  modified_base (417)..(417): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgagtccagttggttgagtcggggagctggtccagccgtgggggtccctgagactctcctgtgcagcctccggacttcccctcagtagttatggatgacttgggtccgccagactccgaggggaaggggtcgtggagtggggtggaccaacaagtaaaagacaaagagtggaactgccccgtaggttttagtgactctgtgaacgggtcgttcaccatctcaganacaacgaccaagaacttcacttagtactctaacaactacgaacacgccttagggaacggtagtaccgacgaagaaccgaccgggtccgttagtagttaacctggtcggcgaagtagttacgggtaaagggttaaaaagttaaagtgggttacgtttggttacggtttttaaggtcgggggtaacccgaagggggtaccgccccgttgggttccccgttaaccccgg

SEQ ID NO: 411178 - DNA, 650 bp, Homo sapiens
  misc_feature: GZ8MTXP01BA99L.17.28.C06.1.454.CMB.2.raw
  modified_base (279)..(279): a, c, t, g, unknown or other
  modified_base (384)..(384): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgaggtccggggagcctggtccagccgtgggggtccctgagactctcctgtgcagccctccggacttcccctnagtagttatggatgacttgggtccgccagacctccgaggggaaggggctgggagtggggtgaccaacataaagcaaagatggaactgtaccccgtagttttacgnggactcgtagtaggaacgggtccgtttacaccatcctaccgagacgaacaacgaccaaagtacttccaacttagtaactctaacaactagaacagcctaggggaagacgtccgacaagaccgacgggtccgttagtaacttacgtggtacgacggtaagtaagttaggggtaaaggaaaaaggttacgtaggttgtttggtttaggtttaagggttcgggggaaccgaagggggtcgttccccggtgggttaacccgtaaccccgg

SEQ ID NO: 411179 - DNA, 545 bp, Homo sapiens
  misc_feature: GZ8MTXP01EQEQK.17.28.C06.1.454.CMB.2.raw
  modified_base (206)..(206): a, c, t, g, unknown or other
  modified_base (318)..(318): a, c, t, g, unknown or other
  modified_base (495)..(495): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggnagaggtcaccatatcttgttctggaaacagctccggcatctcaactaaacatttttgctggtaccagcaattcccaggatccggccccccgactcctcatctatgaaatgancatcggccctcgggtcctgaccgattctctggctccaatgtctggcactcagcctcctcgaccatcagtcgggcgtccggtcccgacggagtgaggcgtgattattaactgtgtcgaccgtgggagtgacatcctgaagtcggtcgggtcggttcggttcgggcgggacgaacggcncgccgttccgttaacgtcgaacgccgaacggccgtcgttccccgtcccgg

SEQ ID NO: 411180 - DNA, 597 bp, Homo sapiens
  misc_feature: GZ8MTXP01CUNEJ.17.28.C06.1.454.CMB.2.raw
  modified_base (334)..(334): a, c, t, g, unknown or other
  modified_base (346)..(346): a, c, t, g, unknown or other
  modified_base (368)..(368): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgttgctgttttagaaggtgtcagtgtgagtcagttggtgagtcggggagctggtcagccgtgggggtccctgagactctcctgtgcagcctccggattccccttcagtattatggatgtacttgggtccgcagactccgaggggaaggggctggaggtgggtgaccaanataaagcaaganaggaactgcccgtagtttacgngactctgtagaacgggtcctttacgaccatcctccagaagaccaacgaccaaagtactacacttagtactctaacaacgtagaaaccagccttaggacgtaagtcgacgaagaccgacgggccgtagttaattacgtgtgacggaataagttggtaaaggaaaaagtaacgtgggttagttggtttagtttaaggtacggggcgagggacgccgttaacgcgtaacccg

SEQ ID NO: 411181 - DNA, 641 bp, Homo sapiens
  misc_feature: GZ8MTXP01EWUAB.17.28.C06.1.454.CMB.2.raw
  modified_base (277)..(277): a, c, t, g, unknown or other
  modified_base (300)..(300): a, c, t, g, unknown or other
  modified_base (336)..(336): a, c, t, g, unknown or other
  modified_base (375)..(375): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgcttgttttagaaggtgtccagtgtgaggtcagttggttgaggtccggggagcctggtccagccgtgggggtccctgagactctctgtgcagcctccggattcccctnagtattatggatgacttggtccncagactccgagggaggggctggagtggtggaccaanataaagcaaagataggaactggaccccgtagttttacgnggactcgtgtggaacgggtcctttacacctatcctaccagacgacaacgaccaaagtaattacacttagtattactaacaaactacgaaacacgccgtagggaacgtaggtccgacgaacgaccgacggtccgttagttattaaccgtggtgcggtaagtagttagggtaaaggttaaaaagttagtaaggttgttggtttaggttttaaggtcgggggtaacccgtagggggaccgttccccggttgggttcccgttaaccccgg

SEQ ID NO: 411182 - DNA, 583 bp, Homo sapiens
  misc_feature: GZ8MTXP01EIHJE.17.28.C06.1.454.CMB.2.raw
  modified_base (297)..(297): a, c, t, g, unknown or other
  modified_base (369)..(369): a, c, t, g, unknown or other
  modified_base (499)..(499): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagctggtccagccgtgggggtcctgagactctcctgtgcagcctccggacttccccttcagtagttattggatgacttgggtccncagactccgagggaaggggctggagtgggtggaccaacataaagcaagatggaactggccgtagttttacgnggtactctgtaggaacgggtccgtttcaccgtatcctaccagagacaaccgcaaagacttcactgttaactctaactaactgaacagcctagagggagtcgacacgacacggccgttagtattacgtgtncgagaattggaaggaaaagttagtggtcttggttgtttaggttggggacctaaggggctaccgttggtccgttaaccgttcccg

SEQ ID NO: 411183 - DNA, 641 bp, Homo sapiens
  misc_feature: GZ8MTXP01CHQAE.17.28.C06.1.454.CMB.2.raw
  modified_base (365)..(365): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtcgtcgggacccccggcagagggtcaccatatcttgttctaggaaacagctccggcatctacaaactaaactatttttgctggtaccagacaacttcccaggactccggccccccgactcctcatctataagaaatgatcactccggcccgtccggggtccctcgaccccgtnttctcgtcggctaccatcgtcgtcgcctacctcacgtccctccctgacctatcgaggtcgggcctccgggtaccgaggacgtggagtctagtaatttacgttacgtggttcgacgtacccgggtgggattacgacctaagttccgtaggtaacgttcggggttcccgggttggttccgggggacgggacggggaccgtagggccgttacggttaccccggttaacctaacggtcccgaacggaccccgttaacgggtccccttaacccccggtcgg

SEQ ID NO: 411184 - DNA, 731 bp, Homo sapiens
  misc_feature: GZ8MTXP01BUQWW.17.28.C06.1.454.CMB.2.raw
  modified_base (214)..(214): a, c, t, g, unknown or other
  modified_base (254)..(254): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtccgtcggggaccccccggganaggacggtaccacctattacttcttgttacgtaggaaacncgtcctccggctatctactaaactaaacttatttcgctacgtaccacgactaacttcccgacggaccgtccccggacccccgtacctccctactactactaataagtaatacgactcgtacgtcccggtccccgtccgggtccctacgtaccccgtcttcgtcgtcgtcctacctatcgtcgtcgccctaccctccaccgtccctcccctacgaccctacgtcggtacgggtccgggtcccgttacccgggtaccggtaagggtacgtacgggacggtacttagttaactttaacggttacgtgtacgaccgtaacggtgggtactacgtactacgtaccgtagtacggttccgggttccgggttcggttaccggggaccggggttacgggacccgtcgggttaccgttaccggacccgttaaccgtaacgtaacccgacccggacccgttacgggtccccgttccccggtcccccg

SEQ ID NO: 411185 - DNA, 730 bp, Homo sapiens
  misc_feature: GZ8MTXP01DNEXS.17.28.C06.1.454.CMB.2.raw
  modified_base (239)..(239): a, c, t, g, unknown or other
  modified_base (247)..(247): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccgggcaggagggtcaccatatcttgttctggaaacngctccggnatctacaactaaactattttgctggtaccagctaattcccaggactcccggcccccgactccctcatctatagaaatgatcatccggccccgtccgggtccctgacccgtattcctctggcctccgaattgtctcggccaccctcacgcccttccctcgaccattacgaggtcgggccttcccgggtaccggagggtaagttcggaacgggtcttaggtaaacttttacgtttaacgggttacggttcggtaccgtacccgggttagggggtaacttcgggtaacctaaaccgtttcccggttagggtaaaaccggtttccgggggttcccggggtttaacgggtttccgggggccggggtaaaccgggggaacccgtaacgggggtccgttaaccgggttaaccccggtttacccgttaaacggtcccgaaccgggtaccccgaacggggttcccgttcccggttcccccccggtttccggg

SEQ ID NO: 411186 - DNA, 618 bp, Homo sapiens
  misc_feature: GZ8MTXP01EEWJX.17.28.C06.1.454.CMB.2.raw
  modified_base (277)..(277): a, c, t, g, unknown or other
  modified_base (380)..(380): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggagcctggtccagccgtgggggtccctgagactctcctgtgcagcctcggattcccctnagtagttatggatgacttgggtccgccagactccgaaggggaggggctgggagtgggtgaccaacataaagcaagataggaactggaccccgtagttttacgnggactcgtgtagaacgggtcctttacacctatcctaccagacgaacaacgaccaaagtaattcaacttagtatactaacaaactgaaacagcctagggaagtgtcgcaagaccacggtccgtagttattactgtagcgaagtattggtaaagggaaaaaagtagtcgggttatttgggttaggttttaaggtcgggggcccgaaggggcgttccccgttaagggttccctaaccccgg

SEQ ID NO: 411187 - DNA, 565 bp, Homo sapiens
  misc_feature: GZ8MTXP01DM4JU.17.28.C06.1.454.CMB.2.raw
  modified_base (275)..(275): a, c, t, g, unknown or other
  modified_base (299)..(299): a, c, t, g, unknown or other
  modified_base (369)..(369): a, c, t, g, unknown or other
  modified_base (486)..(486): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtcttccttgttgctgttttagaaggtgtccagtgtgaggtccagttggtgagtccggggagctggtccagccgtgggggtcctgagactctcctgtgcagcctccggattccccttnagtagtatggatgacttgggtccnccagactccaggggaagggctggagtgggtggccaacataaagcaagatggaactgccgtagttttacgnggactctttgaagggtccctttcacctatctccagacgacaacgccaagattcactgtatctacaactgaacagcctggagagtcgcagacacggccgtagtattactgtgcgaagngttggtaggaaaaagtaagtgggcttggttgttttaagttgggggccgtagggggacgcccgtgggttcctaaccccgg

SEQ ID NO: 411188 - DNA, 599 bp, Homo sapiens
  misc_feature: GZ8MTXP01DY6WW.17.28.C06.1.454.CMB.2.raw
  modified_base (258)..(258): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggaccccggcagagggtcaccatatcttgttctggaaacagctccggcatctacaactaaacntttttgctggtaccagcaaattcccaggactccggccccccgactcctcatctatagaatgatcatccggccctccggggtccctgaccccgattctctggcctcccatcgtctggccacctcacgtccctccctgaccatcagtgggctccggtcgaggactgaggctagtactttattacgtgttacgcgaccggtgggattggaactagtcccgtaggaacgttcggggtcccggttggtttccggggacgggaggggtacccgaaggggttccttcgggaccccgttccgtaaagttccgacggacccgaacgggtcccgttaaccgtcccccccgg

SEQ ID NO: 411189 - DNA, 564 bp, Homo sapiens
  misc_feature: GZ8MTXP01B3X78.17.28.C06.1.454.CMB.2.raw
  modified_base (340)..(340): a, c, t, g, unknown or other
  modified_base (374)..(374): a, c, t, g, unknown or other
  modified_base (483)..(483): a, c, t, g, unknown or other
  modified_base (492)..(492): a, c, t, g, unknown or other
  modified_base (514)..(514): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctgggggtccctgagactctcctgtgcagccctccggattccccttcagtagttatggatgacttgggtccgccagactccagggaggggctggagtgggtggccaanataaagcaagatggaactgccccgagttttacgnggactcgtagtgaagggccgtttcaccatctccagacacaacgccaaagattcatagtatctacaactgaacagcctggagacgtcgcagaccacggccgtgtattacngtgcgaagnttggtaaggaaaaagtagtggnttggttgtttaagttgggggcctaggggacgcccgtggttccgtaacccg

SEQ ID NO: 411190 - DNA, 569 bp, Homo sapiens
  misc_feature: GZ8MTXP01ATVBX.17.28.C06.1.454.CMB.2.raw
  modified_base (185)..(185): a, c, t, g, unknown or other
  modified_base (270)..(270): a, c, t, g, unknown or other
  modified_base (294)..(294): a, c, t, g, unknown or other
  modified_base (320)..(320): a, c, t, g, unknown or other
  modified_base (325)..(325): a, c, t, g, unknown or other
  modified_base (360)..(360): a, c, t, g, unknown or other
  modified_base (394)..(394): a, c, t, g, unknown or other
  modified_base (441)..(441): a, c, t, g, unknown or other
  modified_base (453)..(453): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtntcagtgtgaggtcagttggtgagtccggggagctggtccagcgtgggggtcctgagactctcctgtgcagcctcggattcccctnagtagttatggatgacttggtccncagactcgagggagggctggagtggngcaanataaagcaagatggaactgaccccgtagtttacgnggactcgtgtagaagggtccttcacatctcaganacaacgcaagattcatgtactctaacaactgaaacagcctagggganagtcgacagacncggtcctagtatactgtgcgaagattggtaaaggaaaaagttacgtgggttcttggttacggtttaaggtcgggggaacccgtaagggggcgttcccgttggaaccgtaaccccgg

SEQ ID NO: 411191 - DNA, 610 bp, Homo sapiens
  misc_feature: GZ8MTXP01A9LPG.17.28.C06.1.454.CMB.2.raw
  modified_base (373)..(373): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggtgagtcggggagctggtcagccgtgggggtcctgagactctcctgtgcagcctccggattccccttcagtagttatggatgacttgggtccgccagactccgaggggaggggctgggagtgggtggaccaacaataaagcaaagatggaactgccccgtagtttacgngactcgtgtagaacgggtccgtttcaccgtatcctaccagacgaccaacgaccaaagaacttcaactagtactactaacaactagaaacagacctaggggagaggtccgacgaacgacgacggtccgttagtacttacgtgtcgcggaagtagttaggtaaggaaaaagtagtaggttcgttaggtttgtttaaggttcgggggcctaagggggcttcccggtggttccgtaacccg

SEQ ID NO: 411192 - DNA, 614 bp, Homo sapiens
  misc_feature: GZ8MTXP01EFXCF.17.28.C06.1.454.CMB.2.raw
  modified_base (279)..(279): a, c, t, g, unknown or other
  modified_base (379)..(379): a, c, t, g, unknown or other
  modified_base (556)..(556): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagcctggtccagccgtgggggtccctgagactctcctgtgcagccctcggacttcccccttnagtagttatggatgacgttggtccgccagactccgaggggaggggctggagtgggtggaccaacaataaagcaaagataggaactgcccgtagtttacgngactcgtagtggaagggtcctttcacctatcctacgagaacgacaacgaccaaagtattcacttagtatactaacaaactagaacacgacctaggacggacgtacgacgaagaccgacgggacttaggttacttagtaggtcgagtaagtagttaggtaaaggaaaagttacgtggngttggtttggtttaaggtcggggaacgtaacggggcgcccgttcggttctaaccccgg

SEQ ID NO: 411193 - DNA, 622 bp, Homo sapiens
  misc_feature: GZ8MTXP01D0YNG.17.28.C06.1.454.CMB.2.raw
  modified_base (275)..(275): a, c, t, g, unknown or other
  modified_base (381)..(381): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggttgagtccggggagctggtccagccgtgggggtcctgagactctcctgtgcagccctccggattcccctnagtattatggatgacttgggtccgccagactccgagggaaggggctgggagtgggtgaccaaacataaaagcaaagataggaaactggccccgtaggttttacggngtactcgtagtagaacggtccttacacctatctacagacgaacaacgacaaatactacactagtatactaacaactacgaacacgcgtaggagtacgtcgacgacgacgacggtaccgttagttacttacgtggtacgcgtaagtagttaggtaaaaggttaaaaagttagtacggttcgttggtttaggtttaacggtaggggccgtaggggacgttcccgttcggttaacccgtaaccg

SEQ ID NO: 411194 - DNA, 844 bp, Homo sapiens
  misc_feature: GZ8MTXP01AJYYK.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagccgtgggggtccctgagactctctgtgcagcctccggtacttccccttcagttagttagtggatgtacgttcgggtcccgccagacctccgaggggaggggcgtgggaggtggggtcggacccaaacaagtaaaacgacgaaagagtagggaaactcggtaccccggttaaggtttttacggtggtacctcgttagggtacgggtaacggggttcccgttttaccgaaccctactccgtaccgaaggaacgaaccgaaaccgaccctaaaaggtaacttacctaacttacggttaacttacctaaaccaaacgttacgaaaaccgtacggtaccccgttagggggaacggtaacgggttacccggaccgaaaccgggaacccgtaccgggggtaccccgtttaaggtttaacgttttaaccggttagggttacgggaccgggtaaaggtaagttagggggttaaaaagggttaaaaaaaaggtttaacggttgggggttaaccggttttggggttttaaggggtttttaacgggggtttcggggggaaccccggtaaggggggggtaacccgttcccccgggtttaacgggggttaaccccgttaacccccggg

SEQ ID NO: 411195 - DNA, 652 bp, Homo sapiens
  misc_feature: GZ8MTXP01C2KFS.17.28.C06.1.454.CMB.2.raw
  modified_base (391)..(391): a, c, t, g, unknown or other
  modified_base (545)..(545): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgaggtcggggaggcctggtccagcgtgggggtccctgagctctcctgtgcacgcctccggacttccccttcagttagttatggatgtacgttgggtccgccagactccgaaggggaaggggctgggaggtgggtagaccaaacaataaagcaaagataggaactgaccccgttagttttacggnggtactcgtagtgaacgggtccgtttacactatctaccagacaacaacgaccaaagtaacttacactagtactactaacaacttagaactacggcctaggggaacgacgtcgacgaacgaccgaccgggtccgttagttacttacgtggtacgnggtaaagtagttagggtaaaggaaaaagttacgtgggttgttgggttaggtttaagggtcggggtaacgaggggtaccgttcccggttcgggttcccgttaaccccg

SEQ ID NO: 411196 - DNA, 656 bp, Homo sapiens
  misc_feature: GZ8MTXP01DN19G.17.28.C06.1.454.CMB.2.raw
  modified_base (271)..(271): a, c, t, g, unknown or other
  modified_base (296)..(296): a, c, t, g, unknown or other
  modified_base (380)..(380): a, c, t, g, unknown or other
  modified_base (519)..(519): a, c, t, g, unknown or other
  modified_base (548)..(548): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtcagtgtgagtcagttggtgaggtcggggagctggtcagcgtgggggtcctgagactctcctgtgcagccctccggacttccccttnagtagttatggatgacttgggtccncagactcgaggggaaggggctgggaggtgggtcgaccaaacaataaaagcaaagagtaggaacgtgacccgttaggttttacgngggtactgtaggtgaacggggtccctttacacctatcctaccgaagaacgaccaaacgaccaaagtaacttaccaagttagttaacttactaacaaactagaaaccagccttaggggaagtaggtccgacacggaaccncgggtaccgttaggttaattacgtgtcgnggaaagtagttaaggtaaagggttaaaaaagttacgtgggttacgttttggttaggttttaaggtcgggggtcgaacgggggtacgcccgttggggttccctaacccg

SEQ ID NO: 411197 - DNA, 587 bp, Homo sapiens
  misc_feature: GZ8MTXP01ET0YO.17.28.C06.1.454.CMB.2.raw
  modified_base (298)..(298): a, c, t, g, unknown or other
  modified_base (371)..(371): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggttgagtcggggagctggtcagccgtgggggtcctgagactctcctgtgcagcctccggattccccttcagtagttatggatgacttgggtccnccagactccgagggaaggggctggagtgggtgccaacataaagcaagatggaactgaccccgtagttttacgngactcgtgtggaagggtcctttcaccatcctaccagacgacaacgccaaagaacttcactagtactctaacaactgaaacagcctaggaggaagtcgacagaccgacggccgtagtattactggtgcgaagtagttggtaaaggaaaaagtagtggttacgttgttggtttaaggttcgggggccagggggacgttcccgtggttccgtaacccgg

SEQ ID NO: 411198 - DNA, 534 bp, Homo sapiens
  misc_feature: GZ8MTXP01DCIL2.17.28.C06.1.454.CMB.2.raw
  modified_base (498)..(498): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggcagagggtcaccatatcttgttctggaaacagctccggcatctacaactaaactatttttgctggtaccagcaaattcccaggactccggccccccgactcctcatctatagaaatgatcatccggcccctccggggtcctcgaccccgattctcgtggcctcccatgtctcggcaccctcacgccctccctgaccatcaggtgggcctccggtccgaggactgagctagtattagttactgtcgcaccggtggatgacatcctgagtcgggtcggtgttcggcggaggaccnggcttggaccgtcaagtcacgccagtcttcgccccg

SEQ ID NO: 411199 - DNA, 592 bp, Homo sapiens
  misc_feature: GZ8MTXP01DNH2H.17.28.C06.1.454.CMB.2.raw
  modified_base (302)..(302): a, c, t, g, unknown or other
  modified_base (376)..(376): a, c, t, g, unknown or other
  modified_base (479)..(479): a, c, t, g, unknown or other
  modified_base (508)..(508): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggttttcctgttgctgttttagaaggtgtccagtgtgaggtccagttggttgagtccggggagcctggtccagccgtgggggtccctgagactctcctgtgcagccctccgattccccttcagtagttatggatgacttgggtcctnagactccgagggaaggggctgggagtgggtgccaaacagtaaagcaaagataggaactgcccgtagttttacgnggtactcgtagtagaacgggtccgtttacaaccgtatcctaccaggaacgaacaaacgccaaagtaattcaactgtatctaacaactagaacagcctgggaangtcgcagacgcggccgttagtacttacgngtgcgaagagttggttaaaggaaaaacgtagtggttacgttggttagtttaagtggggccgaagggtcgcctggttctaacccg

SEQ ID NO: 411200 - DNA, 591 bp, Homo sapiens
  misc_feature: GZ8MTXP01A0QW2.17.28.C06.1.454.CMB.2.raw
  modified_base (377)..(377): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagccgtgggggtccctgagactctcctgtgcagcctccggattccccttcagtagttatggatgacgttgggtccgcagactccgaggggaaggggctgggagtgggtgccaacataaagcaagatggaactgccccgtagttttacgnggactcgtagtggaacgggtccctttcaccatctaccagacgacaacgccaaagacttcacttagtatactaacaactagaaacagtcctgggacgaggtccgacagaccgacggccgtagttattacgtgtgcgaagtagttaggtaaagaaaagtatggttcgttggttgtttaaggtggggccgtagggcgttcccgtggttcctaacccg

SEQ ID NO: 411201 - DNA, 540 bp, Homo sapiens
  misc_feature: GZ8MTXP01D270R.17.28.C06.1.454.CMB.2.raw
  modified_base (239)..(239): a, c, t, g, unknown or other
  modified_base (262)..(262): a, c, t, g, unknown or other
  modified_base (470)..(470): a, c, t, g, unknown or other
  modified_base (500)..(500): a, c, t, g, unknown or other
  modified_base (506)..(506): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtctcgggacccccggcaggagggtcaccatatcttgttctggaaacngctccggcatctcaactaaactnttttgctggtaccagcaaattcccgaggactccggcccccactcctcatctatagaaatgatcatccggccctccggggtccctgacccccgtattctctggcctcccattcgtctcggccacctcacgtccctccctgacccatcgaggtcggccgtccggtccgaggtactgagcttagtatttagttacttgtcgcgaccgtggntgacatcctgagtggtcgtgttcgggcggnggacgngcgttgaccgtcagtcacgccagtcgcgtccccg

SEQ ID NO: 411202 - DNA, 590 bp, Homo sapiens
  misc_feature: GZ8MTXP01EYIS3.17.28.C06.1.454.CMB.2.raw
  modified_base (301)..(301): a, c, t, g, unknown or other
  modified_base (375)..(375): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggagcctggtccagccgtgggggtccctgagactctcctgtgcagcctccggattcccctcagtagttatggatgacttgggtccncagactccgagggaaggggctgggagtgggtggccaaacataaagcaagatggaactgccccgtagttttacgnggactcgtagtgaacgggtccctttacgacccatcctaccaagacgaaccaacgacccaaagaacttacaacttagtacttactaacaaactagaaacagccctagggaagagtcgacagacgacggccgtgtattacgtgtgcgaagattaggaagaaaagtagtggcgttgttagtttaagtggggccaggggcgaccgtgggttctaacccg

SEQ ID NO: 411203 - DNA, 661 bp, Homo sapiens
  misc_feature: GZ8MTXP01BQWKT.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactggttttccttgttgctgttttagaggtgtcagtgtgaggtcagttggtgaggtcggggagctggtccagccgtgggggtcctgagctctcctgtgcagcctccggacttccccttcagttagttagtggatgtacgttggtccgcagactccgaggggaaggggctgggaggtgggtggaccaacaataaagcaaagataggaactcggaccccgttaggttttacggtggacttcgtaggtagggaacgggtcccgttttacacccgtatcctacgaagacgaacaacgaccaaagtacttcacttagtacttctaacaactagaaacagcctaggggaacgtaggtccgacaacggaccgaccgggtccgttagtacttacgtggtcgagaaggtattagggtaaaggttaaaaagttacgtggggttactttgggtttaggtttaagggttacggggggccctagggggtaccggttcccgttcggggtttccctaaccccgg

SEQ ID NO: 411204 - DNA, 550 bp, Homo sapiens
  misc_feature: GZ8MTXP01B73IO.17.28.C06.1.454.CMB.2.raw
  modified_base (236)..(236): a, c, t, g, unknown or other
  modified_base (303)..(303): a, c, t, g, unknown or other
  modified_base (427)..(427): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacngctccggcatctcaactaaacatttttgctggtaccagcaattcccaggactcggccccccgatccncatctatagaaatgatcatcggcctccgggtccctgaccgattcctctggacctcccaatcgtctggtcacctcacgcctccctgaccatcagtggctccggtcgagatgagctgattattacngtagcaccgtggatgacatcctagtaatcggtccggtggttcggcgggagggaccgaagggcttacgccgttacctaaaggtccaacggccccaaagggttcctccggttcccccgttccggg

SEQ ID NO: 411205 - DNA, 674 bp, Homo sapiens
  misc_feature: GZ8MTXP01CSUKV.17.28.C06.1.454.CMB.2.raw
  modified_base (400)..(400): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggtgagtcggggagctggtccagcgtgggggtcctgagctctctgtgcagcctccggacttccccttcagttagttatggatgtacgttgggtccgccagactccgaggggaaggggcgtgggaggtgggggtaggaccaaacgaagtaaaaggacaaaggaagtacggaactcggaccccgttaggtttttacggnggtacttcgtagggttaggtaacgggtcccgtttacgaccctatcctaccgagaacgacaacgacctaaagtaacttacaacttagtaactactaacaactagaaacacgtacctaggggacgtacggtacgacgaagaccgaacggtacgtagttacttacgtgtcgcgaagtagttagggtaaaggaaaaagttagtggttagtttggtttaggttttaaggttcgggggaaccgtagggggtacgttccccgttgggttcccgtaacccgg

SEQ ID NO: 411206 - DNA, 763 bp, Homo sapiens
  misc_feature: GZ8MTXP01ARBT5.17.28.C06.1.454.CMB.2.raw
  modified_base (210)..(210): a, c, t, g, unknown or other
  modified_base (240)..(240): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtcgtcggggacccccggnaggaggtcaccatatcttgttctggaaacngcctccggcatctacaaacttaaactattttcgctaggtaaccagacctaacttccccgaggacctccccggacccccccgtacttccctacacttactaataagaaatcgacttccgacgtcccggtcccccgttccgggggtcccctacggtaaccccccgtactttccgtccgtcggtccctaaccctagttcggtctccgggaccctaacccgtttacgccccttacccgtacgaccctactccggtagggtcggggtacccgttcccggggtaccggaagggtacttcgggaacgggtcttaggttaacttttaacgttacggttcggttacggtaccgtaaccgggttggggaacttcggaaccttaacgtcccgtaaggtaacggttcgggggttcccgggttgggttacggggacggggaacgggacccgtaggggtccttaccgggttaccgttacccggtaacgtccggaaccgtaccccgtaagggccccgtcccggttccccccgttccgg

SEQ ID NO: 411207 - DNA, 590 bp, Homo sapiens
  misc_feature: GZ8MTXP01B5DGR.17.28.C06.1.454.CMB.2.raw
  modified_base (269)..(269): a, c, t, g, unknown or other
  modified_base (365)..(365): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtcagtgtgaggtcagttggtgagtcggggagctggtccagccgtgggggtcctgagactctctgtgcagcctccggattcccctnagtagttatggatgacttgggtccgcagactcgagggaggggctggagtgggtgaccaacataaagcaagatggaactgaccccgtagttttacgnggactctagtgaacgggtcctttcaccatctacagacgacaacgccaaagattcactgtaatctaacaactagaacagcctagggacgtagtccgacaagaccacgggccgttagtattacgtggtgcgaaggattagggtaaggaaaaagttagtggactttggttaggttttaaggtcgggggtcctaagggggacgttccccgttgggttccctaaccccgg

SEQ ID NO: 411208 - DNA, 595 bp, Homo sapiens
  misc_feature: GZ8MTXP01D1U1Z.17.28.C06.1.454.CMB.2.raw
  modified_base (344)..(344): a, c, t, g, unknown or other
  modified_base (382)..(382): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagccgtgggggtccctgagactctcctgtgcagccctccggattccccttcagtagttatggatgacgttgggtccgccagactccgaggggaaggggctggaggtgggtgccaanataaagcaaagatggaactgaccccgtaggttttacgnggtactcgtagtgaaggggtcctttcaccctagtcctaccgagacgacaacgaccaaagaatcactagtatactaacaactagaaacagcctaggagagtcgcagaccgacggccgtgtattacgtgtgcgaagagttaggtaggaaaaagtagtggcgttgttaggtttaagtcgggggaaccagggggacgcccgttggttccgtaacccg

SEQ ID NO: 411209 - DNA, 585 bp, Homo sapiens
  misc_feature: GZ8MTXP01A6SS9.17.28.C06.1.454.CMB.2.raw
  modified_base (208)..(208): a, c, t, g, unknown or other
  modified_base (472)..(472): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccggnaggagggtcaccatatcttgttctgaaacagctccggcatctacaaactaaactattttgctggtacagcaacttcccgaggactccggccccccgactcctcatctatagaaatgatcacgtccggccccgtccggggtccctcgacccccgtattctcgtcggcctaccatcgtctcgggcccaccctcacgccctccctagacccatcgaggtcgggcctcccgggccgagacgtgacgtctagtattagttacgtgtacncgaccggtgggatgactacgtctagaagtcgggtcggtgggttcgggcgggttacggaccgaggcgttcggacccgtcgtacgcgacgtcccgaggtcccgttccgtcccccg

SEQ ID NO: 411210 - DNA, 613 bp, Homo sapiens
  misc_feature: GZ8MTXP01ATI8W.17.28.C06.1.454.CMB.2.raw
  modified_base (261)..(261): a, c, t, g, unknown or other
  modified_base (399)..(399): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccggcagagggtcaccatatcttgttctggaaacagctccggcatctcaactaaactnttttgctggtaccagcaattcccaggactccggccccccgactccctcactctatagaaatgatcatccggccctccggggtcctgaccccgattctctggcctccatcgtctggcacctcacgccctccctgacccntccgaggtcggacctcccgggtcgaggtcgtgacggtctagtaactttaggtttactggttcgaccgtaccggtgggactggacctagtcccgtagtaacgtgggttaaccggtcgggttcggggaccggacggggacccgaagggttccgttcggacccgttcgtaaacggtccgaacggccccgaacgggtcccttcccggtaaccccccgg

SEQ ID NO: 411211 - DNA, 604 bp, Homo sapiens
  misc_feature: GZ8MTXP01D9A5O.17.28.C06.1.454.CMB.2.raw
  modified_base (270)..(270): a, c, t, g, unknown or other
  modified_base (371)..(371): a, c, t, g, unknown or other
  modified_base (541)..(541): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtcagtgtgaggtcagttggtgagtcggggagctggtcagcgtgggggtcctgagactctcctgtgcagcctccggattccccttnagtagttatggatgacttggtccgcagactccgagggaggggctgggagtgggtgaccaaacataaagcaaagataggaaactgaccccgtagttttacgngtactctagtagaaggggtcctttacaccctatcctccaagacgaacaacgaccaaagaacttcaacttagtatactaacaactagaacagcctagggacgagtcgacaagacgacggtacgttagtattacgtgtgcgaagtagttaggtaaaggaaaaagtagtcggngtttggttagttttaagggttcggggaaccgaggggaccgttccgttcggttccgtaaccccg

SEQ ID NO: 411212 - DNA, 544 bp, Homo sapiens
  misc_feature: GZ8MTXP01BBESK.17.28.C06.1.454.CMB.2.raw
  modified_base (370)..(370): a, c, t, g, unknown or other
  modified_base (537)..(537): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggtttcctgttgctgtttagaaggtgtccagtgtgaggtccagttggttgagtccggggagcctggtccagcctggggggtccctgagactctcctgtgcagcctccggattccccttcagtagttatggatgacttgggtccgccagactccgaggggaaggggctggagtggggtggccaacataaagcaagatggaaactgccgtagttttacgnggactctgtgaagggcctttcaccatctccagagacaacgccaagattcactgtatctacaactgaacagcctgaggagtcgcagacacggcgtgtatactgtgcgagaatgaggaaaattagtggcttgttgtttagtgggggcctaaggggcgcccgttggtccnccggtcc

SEQ ID NO: 411213 - DNA, 566 bp, Homo sapiens
  misc_feature: GZ8MTXP01BH24B.17.28.C06.1.454.CMB.2.raw
  modified_base (280)..(280): a, c, t, g, unknown or other
  modified_base (379)..(379): a, c, t, g, unknown or other
  modified_base (498)..(498): a, c, t, g, unknown or other
  modified_base (548)..(548): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagccgtggggggtccctgagactctcctgtgcagcctccggattccccttnagtagttatggatgacttgggtcccgccagactccgaggggaggggctgggagtgggtgccaacataaagcaagatggaactgccccgtagttttacgnggactcgtagtgaagggtccgtttcaccatctccagacgacaacgccaaagattcactgtatctaacactgaacagcctggagagtcgcagacacggccgtagtacttactgtgcgaanagttggtagaaaagtagtggacttgttagtttaagtggggccaggggacncccgtggttcctaacccg

SEQ ID NO: 411214 - DNA, 629 bp, Homo sapiens
  misc_feature: GZ8MTXP01A21I2.17.28.C06.1.454.CMB.2.raw
  modified_base (376)..(376): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagctggtccagcctgggggtccctgagactctcctgtgcagcctccggattccccttcagtagttatggatgacttgggtccgccagactccgaggggaaggggctgggaggtgggtgaccaacataaagcaagataggaactgccccgtagttttacgnggtactcgtgtaggaaggggtcccgtttacacctatcctacccaaggaacgaaccaaacgacccaaagtaacttcacttagtactcctaacaactgaaaccagcctaggacgagtcgacaggaccgacggccgttagtacttacgtgtcgacgaagtagttggtaaaggaaaagtaagtgggttcgttgggttgtttaaggttcgggggaacccgtaaggggaccgttccccgttgggttcccgtaaccccgg

SEQ ID NO: 411215 - DNA, 640 bp, Homo sapiens
  misc_feature: GZ8MTXP01AY6RR.17.28.C06.1.454.CMB.2.raw
  modified_base (206)..(206): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggnagagggtcaccatatcttgttctggaaacagctccggcaatctacaactaaactatttttgctggtaccagcaattcccaggactccggcccccgactccctcatctataagaaatgatcagtccggcccctccgggggtccctacgaccccgtattctcgtggcctaccatcgtctggccacctcacgcctccctcgaccatcgagtcgggctcccgggtacgaggactggcgcttgtaactttaacgttactgggtccgacgtaccgggtgggtactcggaacctacgtccgtagaacggttcggggttaaccccgggttgggtttccggggaccggggacggggtacccgaggggaccgttcggacccggttcccgttaaacggtcccgaacgggacccccgaaaggggtcccttccccgggtccccccgg

SEQ ID NO: 411216 - DNA, 657 bp, Homo sapiens
  misc_feature: GZ8MTXP01B7KV5.17.28.C06.1.454.CMB.2.raw
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggcagagggtcaccatatcttgttctggaaacagctccggcatctacaactaaactatttttgctggtaccagcaattcccaggactccggccccccgactcctcatctataagaaatgatcatccggccccgtccgggtccctcgaccgtacttcctcgtcggcctccaattcgtctggcctaccctcacgcccctccctcgaccctatccgaggtcgggcctcccgggtaccgaggatggaggctagtatttacgttacgtgtggacctacggtagggatacggactaacgtccgtaggtaaacgttcggggttcccgggttgggttccggggcgggggtaaacgggccccgtaaggggtcccttacgggttaccccggtttacccgtaaacgggttcccgaaccggtaccccgaacggggttccccttccccgggcccccccgtttccggg

SEQ ID NO: 411217 - DNA, 529 bp, Homo sapiens
  misc_feature: GZ8MTXP01BF5PQ.17.28.C06.1.454.CMB.2.raw
  modified_base (205)..(205): a, c, t, g, unknown or other
  modified_base (235)..(235): a, c, t, g, unknown or other
  modified_base (258)..(258): a, c, t, g, unknown or other
  modified_base (453)..(453): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccacctcagtgtctgggacccccggnagagggtcaccatatcttgttctggaaacngctccggcatctcaactaaactnttttgctggtaccagcaaattcccaggactccggccccccgatcctcatctatagaaatgatcatcggccctccggggtcctgaccccgattctctggctccatgtctggcacctcacgcctaccctgacccatcaggttcgggctccggtccgaggatggagctgtattagttactgtgcaccgtggatgaacntcctgaacgtggtcggtcgttcgggcggagggaccaggcgttgaccgtctaaggcacgcccaggtccttcgccccg

SEQ ID NO: 411218 - DNA, 631 bp, Homo sapiens
  misc_feature: GZ8MTXP01EM2B3.17.28.C06.1.454.CMB.2.raw
  modified_base (279)..(279): a, c, t, g, unknown or other
  modified_base (377)..(377): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggagcctggtccagccgtgggggtccctgagactctcctgtgcagccctccggacttccccttnagtagttatggatgacgttgggtccgccagactccgaggggaggggctgggagtgggtgccaacataaagcaagatggaactgcccgtagttttacgnggtactcgtgtgaacgggtcctttacaccatctaccagacacaacgccaaagacttcacttagtactactaacaacttacgaaacacgtcccgtaggggaacgtacggtaccgacgaaggaccgaaccgggtcccgttagttaacttaccgtggtcgcggtaagtagttagggtaaaggttaaaaagttagtaggttcgttgtttaggtttaaggttggggccgtaggggcgttcccgtggttcccgtaacccg

SEQ ID NO: 411219 - DNA, 604 bp, Homo sapiens
  misc_feature: GZ8MTXP01CD7U7.17.28.C06.1.454.CMB.2.raw
  modified_base (208)..(208): a, c, t, g, unknown or other
  modified_base (239)..(239): a, c, t, g, unknown or other
  modified_base (474)..(474): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcggggacccccgggnagagggtcaccatatcttgttctaggaaacngctccggcatctacaactaaactattttgctggaccagcaaacttcccaggactccggccccccgatccctcatctatagaaatgatcagtccggccccgtccggggtccctcgaccgtacttcctctggcctccaattcgtctcggccacctcacgccctccctgaccatcaggtcggctcccggtacgaggatggaggctgatttattacgtgtgccacggtgggactggacnctccgtggtaacgtcggggttccggtggttccgggcggggtacgggaccgtagggtcttacgggttcccgttacccgtaaggtccgaaccggcccgtaacggggccctcccgggttccccccgttccggg

SEQ ID NO: 411220 - DNA, 617 bp, Homo sapiens
  misc_feature: GZ8MTXP01EBT0Z.17.28.C06.1.454.CMB.2.raw
  modified_base (208)..(208): a, c, t, g, unknown or other
  modified_base (235)..(235): a, c, t, g, unknown or other
  modified_base (255)..(255): a, c, t, g, unknown or other
  modified_base (454)..(454): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccggnaggaggtcaccatatcttgtctgaacngctcgcatcacaactaactnttttgctggtaccagctaacttcccaggactcccggcccccgactccctcatctaataagaaattgactcacgtccggaccccgtccggggtccctcgacccccgtattctcgtggcctacccattcgtcgtggacccaccctcacgtccctccctcgacctatcgaggtcgggccgtccgggtcgaggagtggacgtntagtatttacgttcgtgtcgccgtacggtggtatacgaactcgtcgtagtacggttcgggttcggttcgggttccgggacgggttacgggaccgtacgggttccgttcggttacccgttaacgtaacgtccgaccggacccgacggtcccgttcccgtccccg

SEQ ID NO: 411221 - DNA, 613 bp, Homo sapiens
  misc_feature: GZ8MTXP01EY3E7.17.28.C06.1.454.CMB.2.raw
  modified_base (277)..(277): a, c, t, g, unknown or other
  modified_base (381)..(381): a, c, t, g, unknown or other
  modified_base (406)..(406): a, c, t, g, unknown or other
  modified_base (410)..(410): a, c, t, g, unknown or other
  modified_base (462)..(462): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggtgagtccggggagcctggtccagccgtgggggtccctgagactctcctgtgcagccctccggacttcccctnagtattatggatgacttgggtccgcagacctccgaggggaggggctgggagtgggtcgaccaacataaagcaaagatggaaactggaccccgtagtttttacgnggactcgtagtgaagggtccctttnaccntctccagagacaacgccaaagtaattcattagtatctaacgaactagaaacncgacctgggagagtcgacagaccgacgggccgtagtacttacgtgtggcgaagattagggtaaaggaaaaaagttagtggacgttggttaggtttttaaggcgggggtaacccgtaagggggcgttccccgtaagggttccctaaccccgg

SEQ ID NO: 411222 - DNA, 610 bp, Homo sapiens
  misc_feature: GZ8MTXP01BF4PA.17.28.C06.1.454.CMB.2.raw
  modified_base (303)..(303): a, c, t, g, unknown or other
  modified_base (376)..(376): a, c, t, g, unknown or other
  modified_base (448)..(448): a, c, t, g, unknown or other
  modified_base (535)..(535): a, c, t, g, unknown or other
tcagcgtagactagcacgaccggtgctcgatttagagctcacgtattgggtttggggaggtctcagagaggaggcttagccctggactccaaggcctttccacttggtgatcagcacttagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattccccttcagtagttattggatgacttgggtccnccagacctccgagggaaggggctggagtggggtgaccaacataaagcaagatggaactgccgtagttttacgnggactctgtgaacgggtccgtttcaccatcctccagacgacacgacaagatcatgtatactacaactgaacncgctgaggagtcgacagaccgcggtccgtagttaacttcgtgtgtacggagtaagttaggttaaagggtaaaaagttagtacgggtntttagggttagttttagggttcgggggcgtaagggggaccgtccccggttagggtaacccgttaaccggttcccc

SEQ ID NO: 411223 - DNA, 589 bp, Homo sapiens
  misc_feature: GZ8MTXP01AZ70Y.17.28.C06.1.454.CMB.2.raw
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcggggacccccgggcagagggtcaccatatcttgttctggaaacagctccggcatctacaactaaactattttgctggtaccagcaacttcccaggactcccggccccccgactccctcatctatagaaatgatcagtccggccccgtccggggtccctgaccgtacttctctcggctccaatgtctggccacctccacgccctccctgacccagtcgaggtcgggcctccgggtaccgagggtatggagctagtattagttacgtggtcgcgtacggtgggatgactatccgtgtaagtcgggttccgggtggttcgggacggggtacggccgacgggcttcggcccgttactaaggtccgaacgtccccgagggttccctccggccccgttcgg

SEQ ID NO: 411224 - DNA, 654 bp, Homo sapiens
  misc_feature: GZ8MTXP01BVN1N.17.28.C06.1.454.CMB.2.raw
  modified_base (374)..(374): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggtgagtcggggagctggtccagccgtgggggtccctgagactctcctgtgcagcctccggattcccctcagtagttatggatgacttgggtccgccagactccgagggaaggggctgggagtgggtgaccaacataaagcaagataggaactgaccccgtagttttacgnggtactcgtagtggtaagggtcccgtttacgacctactctaccagacgacaacgaccaaagaacttacactagtactctaacaactagaacagccctagggaagtacgtacgacgaacgaccgaccgggtccgttagtaacgtttacgtggtggcgtaaggtagttagggtaaagggttaaaaaagttagtacgggttacgttgggtttacggttttaaggttacggggggaacccgtaagggggtccgttaccccggttcgggttcccgttaaccccgg

SEQ ID NO: 411225 - DNA, 587 bp, Homo sapiens
  misc_feature: GZ8MTXP01BYGY3.17.28.C06.1.454.CMB.2.raw
  modified_base (206)..(206): a, c, t, g, unknown or other
  modified_base (346)..(346): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggnagagggtcaccatatcttgttctggaaacagctccggcatctacaaactaaactatttttgctggtaccagcaaattcccaggactccggccccccgatcctcatctatagaaatgatcatccggccctccggggtcccngaccccgattctctggctccatgtctggccacctcacgcctccctgaccatcaggtcgggccttccgggtccgaggatggacgcttgtatttacgttactggtcgcgtaccggtgggactggaactatccgtagtaacgttggggtcccggttggttccggggcgggttagggacccagggttccgttcggaccccgttctaaggtccacggaccccgagggtcccttccggtcccccccg

SEQ ID NO: 411226 - DNA, 593 bp, Homo sapiens
  misc_feature: GZ8MTXP01D0J3S.17.28.C06.1.454.CMB.2.raw
  modified_base (298)..(298): a, c, t, g, unknown or other
  modified_base (467)..(467): a, c, t, g, unknown or other
  modified_base (471)..(471): a, c, t, g, unknown or other
  modified_base (524)..(524): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattcccttcagtagttattggatgacttgggtccncagactccgagggaaggggctggagtgggtggaccaacataaagcaaagatagggaactggaccgtagttttacgtggactctggtagaagggtccgtttacaccatctccaagaaacaaacgcaaagaattcacttgtattacaacaactgaacagcctgagaggtcngaanacgacggccgtgtaattactgtgcgtagattaaggtaaaggaaaagttaaagnggtaccgttggttgtttaacgttgggggaacccaagggggctcccgtgggttccaaccgttctaacccc

SEQ ID NO: 411227 - DNA, 602 bp, Homo sapiens
  misc_feature: GZ8MTXP01BZ2QM.17.28.C06.1.454.CMB.2.raw
  modified_base (471)..(471): a, c, t, g, unknown or other
  modified_base (540)..(540): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagcctggtccagccgtgggggtccctgagactctcctgtgcagcctccggacttccccttcagttagttatggatgacgttcgggtccgccagaccgtccgaggggaaggggcgtgggaggtggggtcggaccaaacataaaagcaagataggaactggaccgttagttttacggtggactcgtggtaggaacgggtccgtttcaccctatctaccagagacaacgcaaagtatcactgtaactctaacactagaacngctgagggatcgacagacacggtcgtgtacttactggtgcgagaagtgttaaagggaaaattgacggtnttagggttgttttaagggtggggccgtaaggggtacgcccggttgtccgttaacccggttcc

SEQ ID NO: 411228 - DNA, 700 bp, Homo sapiens
  misc_feature: GZ8MTXP01DWREW.17.28.C06.1.454.CMB.2.raw
  modified_base (392)..(392): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagcctggtcagccgtgggggtccctgagactctcctgtgcagcctccggacttcccctcagtagttatggatgacgttgggtcccgccagactccgaggggaaggggcgtgggaggtggggtggacccaaacataaaagacgaaagagtggaaactggccccgtaggttttacgnggtacctcgtaggttagaacggggtcctttacacctatcctaccgaagaacgaaccaaacgaccaaagtaacttacaacttagttaactacctaaacaaactagaaaccagtccctaggggaagacgtacgacgaacgaccgtacggtcccgttaggttaacttaccgtaggtacggcggtaaaggtagttaagggtaaagggttaaaaaaaggttaacgtgggttacgttggtttagggttttaagggttcgggggaacccgtaagggggtaccgttcccccgggtttggttccccgttaaccccgg

SEQ ID NO: 411229 - DNA, 634 bp, Homo sapiens
  misc_feature: GZ8MTXP01AHETS.17.28.C06.1.454.CMB.2.raw
  modified_base (209)..(209): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtcgtcgggacccccggnagagggtcaccatatcttgttctaggaaacagcctccggcatctacaaactaaactattttgctggtaccagacaacttcccgaggactcccggccccccgactcctcatctatagaaatgatcacgtccggccccgtccggggtccctcgaccccgtactttctcgtcggcctacccattcgtctcgggcctacccgtcacgtccctccctcgaccctatcgacggtcgggcccgtacccgggtccgaggtacgtggacgtcttagtactttaagttacgtggttcgaccgtaccggtgggatacgactgtccgtaggtaacgttcggggttcgggtggttccggggcgggacgggtaccgaggttcgttcggttacccgtaacgtaacgccgtacggacccgaggtccgttcccggtcccccg

SEQ ID NO: 411230 - DNA, 635 bp, Homo sapiens
  misc_feature: GZ8MTXP01AFVUQ.17.28.C06.1.454.CMB.2.raw
  modified_base (378)..(378): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggaggcctggtccagccgtgggggtcctgagactctcctgtgcagcctccggtacttccccttcagtagttattggatgacgttgggtcccgccagactccgaggggaaggggctggagtggggtggaccaacataaagcaaggatggaactcgccgtagtttacgnggactcgtgtagagggtccctttcacctatctccgagacgaacaacgacaaagtattcacttagtatctaacaactagaactagcctaggaggacgtcgcaacggtaccgacggtcccgttagtacgttactggtcgacggtaggtaagttagggttaaagggaaaaaaggttaagtgggtacgtttggttggttttagggttcgggggacccgtaagggggtaccgccccggttggggttcccaacccggtttccc

SEQ ID NO: 411231 - DNA, 694 bp, Homo sapiens
  misc_feature: GZ8MTXP01C2YTN.17.28.C06.1.454.CMB.2.raw
  modified_base (211)..(211): a, c, t, g, unknown or other
  modified_base (239)..(239): a, c, t, g, unknown or other
  modified_base (379)..(379): a, c, t, g, unknown or other
  modified_base (396)..(396): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcgacgggtcctcgggcccagtctgtgctgactcacgccaccctcagtgtcgtcgggaccccggnagaggtcacatatcttgttctagaaacngcgtccgcatctacaactaacttattttgctggtacagactaacttcccgaggactcccggcccccactcctcatactaataagaatgatcacgtccggccccgtccgggtcctacgacccgtattctcgtcgcctaccntcgtctcggacctaccnccacgtccctaccctacgtaaccctactacggcgggttccggggtcccgtacccggggttccggaaggggtacgttcgggaacggttcgttaagttaaccttttacggtttaaccggtgggttaccggtacccggtaaccgggttggggaacttacggaaccttaccgttacccgtggtaaaccggttcggggttccgggttcgggttccggggacgggttacgggaaaccgcgggttcgttcggttaaccccgttctaacggtcgaccgacccggacggtcccgttcccgtcccccg

SEQ ID NO: 411232 - DNA, 560 bp, Homo sapiens
  misc_feature: GZ8MTXP01B0010.17.28.C06.1.454.CMB.2.raw
  modified_base (302)..(302): a, c, t, g, unknown or other
  modified_base (372)..(372): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattccccttcagtagttatggatgacttgggtccncagactccagggaggggctggagtgggtggccaacataaagcaaagatggaactgccccgagttttacgnggactctgtgaagggcctttcacatctccagagacaacgcaagattcactagtatctacaactgaacagcctaggagtagtcgacgagacgacggccgtagtattacgtgtgcgaagattggtaaggaaaagtatggcttggttgtttaaggttcggggcctaaggggcgcccgtgggttctaacccg

SEQ ID NO: 411233 - DNA, 676 bp, Homo sapiens
  misc_feature: GZ8MTXP01DB211.17.28.C06.1.454.CMB.2.raw
  modified_base (277)..(277): a, c, t, g, unknown or other
  modified_base (375)..(375): a, c, t, g, unknown or other
tcagcgtagactagcacgaccggtgctcgatttagagctcacgtattgggtttggggaggtctcagagaggaggcttagccctggactccaacggcctttccacttggtgatcagcactgagcacagaggactcaccatggagttggggctgaactgggttttccttgttgctgttttagaaggtgtccagtgtgaggtccagttggttgagtcggggagcctggtccagcgtgggggtccctgagctctcctgtgcagccctccggattccccttnagtagttatggatgacttgggtccgccagactccgaggggaaggggctggagtgggtgaccaaacataaagcaagataggactgcccgtagtttacgngactctgtgaagggtcctttcaccgtatcctaccgagacgaacaacgaccaaagaattcaactgtatctaacaacttagaacagccgtagggaagacgttacgacaacggaccgaccggtaccggttagttaacgttaacgttggtcgacggtaaaggtaagttagggttaaacgggaaaaaaagggtttaaacgttggggttaccgtttggggtttaagggtttttaacgggtttacggggggccccgttaaaggggggaccgttaccccgggttcggggttaacccgtttaacccccgg

SEQ ID NO: 411234 - DNA, 536 bp, Homo sapiens
  misc_feature: GZ8MTXP01B1ARQ.17.28.C06.1.454.CMB.2.raw
  modified_base (236)..(236): a, c, t, g, unknown or other
  modified_base (448)..(448): a, c, t, g, unknown or other
  modified_base (453)..(453): a, c, t, g, unknown or other
  modified_base (489)..(489): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggcagagggtcaccatatcttgttctggaaacngctccggcatctcaactaaactattttgctggtaccagcaattcccaggactccggccccccgatcctcatctatagaaatgatcatccggccctccggggtccctgaccccgtattctctggctcccattcgctcggcacctcacgccctccctgaccatcagtcgggctccggtcgaggatgagctgatttagtactgtgcgccggtggntgacntcctgacgtgggtccggtgttcgggcggagggaccngggcttcggacccgtctaagtcacggcccaggtcccttcgtcccccg

SEQ ID NO: 411235 - DNA, 580 bp, Homo sapiens
  misc_feature: GZ8MTXP01BTQOH.17.28.C06.1.454.CMB.2.raw
  modified_base (302)..(302): a, c, t, g, unknown or other
  modified_base (377)..(377): a, c, t, g, unknown or other
  modified_base (449)..(449): a, c, t, g, unknown or other
  modified_base (499)..(499): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagctggtccagccgtgggggtccctgagactctcctgtgcagccctccggattccccttcagtattatggatgacttgggtccncagactccgaggggaaggggctgggagtgggtgccaacataaagcaaagatggaactgccccggtagttttacgnggtactctgtgaagggtccgtttcacccatcctccagacgacaacgccaaagattcatgtatctaacaactnaaacagcctgggagagtcgacagaccgacggccgtagtattacgtgtcgngaagtattgggtaaaggaaaagtacgtggacttggttgttttaagtcgggggccaaggggcgcccgtggttaacctcccgg

SEQ ID NO: 411236 - DNA, 638 bp, Homo sapiens
  misc_feature: GZ8MTXP01DJ04N.17.28.C06.1.454.CMB.2.raw
  modified_base (278)..(278): a, c, t, g, unknown or other
  modified_base (341)..(341): a, c, t, g, unknown or other
  modified_base (379)..(379): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtcagtgtgaggtccagttggttgagtccggggaggcctggtccagccgtgggggtccctgagactctcctgtgcagccctccggattcccctnagtattatggatgacttgggtccgccagactccgagggaggggctggagtgggtggaccaaanataaagcaaagataggaactgaccccgtagttttacgnggactcgtagttaggaacggggtccctttacacctatcctaccagacgaacaaacgaccaaagtaacttcactagtactactaacaaactgaaacagcctagggagtagtcgacgacgaacgacggccgttagtattacgtagtcgcgtaagtagttagggtaaaggttaaaaaagttaagtgggttacgtttggtttaggttttaaggttcgggggtaacccgtagggggacgttccccgttaagggttcctaaccgg

SEQ ID NO: 411237 - DNA, 644 bp, Homo sapiens
  misc_feature: GZ8MTXP01B2G7F.17.28.C06.1.454.CMB.2.raw
  modified_base (388)..(388): a, c, t, g, unknown or other
  modified_base (418)..(418): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtcggggagctggtccagccgtgggggtcctgagactctcctgtgcacgcctccggacttccccttcagtagttatggatgtacgttcgggtccgccagactccgaaggggaaggggctgggagtggggtcggaccaacaataaagcaaagatggaaactgaccccgtagtttacgngtactcgtagtagaagggtcctttcacctntctaccagacgacaacgaccaaagacttcactagtactactaacaactagaaacagtccctaggggaacgtacgtcgacgaacgaccgacgggtccgttagtattaccgtggtacgcggaagtaagttagggtaaaggaaaaagttacgtgggttctttaggttaggttttaagggtcgggggtaaccgtaagggggcgttaccccgttgggttcccgtaacccgg

SEQ ID NO: 411238 - DNA, 741 bp, Homo sapiens
  misc_feature: GZ8MTXP01AC8Z1.17.28.C06.1.454.CMB.2.raw
  modified_base (282)..(282): a, c, t, g, unknown or other
  modified_base (405)..(405): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagccgtgggggtccctgagactctcctgtgcacgccctccggacttcccccttnagttagttatggatgacgttcgggtcccgcagacctccggaggggaaggggctgggaggtgggtcggaccaaacgaagtaaaagcgaaagataggaaactcggaccccgttaggttttacggnggtactcgtaggtagggaacgggtcccgtttacacctattccgtaccgaaggacgaaaccgaaacccggaaccctaaaaggtaaacttacctaacttacggttaacttacctaaacctaaacgttacgaaaccaacggtcccgtaagggggaacggtacggtccgaacgaacggaaccgtacccggggtaccgtttaggttaactttaccgtggtcggacggaaggtagttagggtaaaagggaaaaaagttaaggttcgggttacgtttgggtttagttttaaggggtcggggaaccggaagggggtccgttcccgttgggttcccgtaaccccg

SEQ ID NO: 411239 - DNA, 605 bp, Homo sapiens
  misc_feature: GZ8MTXP01E1RFG.17.28.C06.1.454.CMB.2.raw
  modified_base (302)..(302): a, c, t, g, unknown or other
  modified_base (383)..(383): a, c, t, g, unknown or other
  modified_base (511)..(511): a, c, t, g, unknown or other
  modified_base (545)..(545): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgttttagaaggtgtccagtgtgaggtccagttggttgaggtcggggagctgtccagccgtgggggtcctgagactctcctgtgcagcctccggattccccttcagtagttatggatgacttgggtccncagactccgaggggaaggggctgggaggtgggtaggaccaaacataaaagcaaaggataggaactgccccgtagtttacgnggactcgtgtgaacgggtcctttcacctatctcagagacaacgacaaagtatcatagtatctaacaatgaaacagcctagggagtacggtcgacgacgaccaccgggccgttggttacttacgttggngcgaaggtattagggaaaggaaaagtaatcgggntttggttgggttttaagtcgggggaaccgaggggacgttccccgtggttcctaaccccgg

SEQ ID NO: 411240 - DNA, 601 bp, Homo sapiens
  misc_feature: GZ8MTXP01EAEC0.17.28.C06.1.454.CMB.2.raw
  modified_base (273)..(273): a, c, t, g, unknown or other
  modified_base (373)..(373): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggttgagtcggggagcctggtcagcgtgggggtccctgagactctcctgtgcagcctccggattcccctnagtagttatggatgacttgggtccgcagactccgaggggaaggggctggagtgggtggaccaaacataaagcaaagatggaactgcccgtagttttacgnggtactcgtagtagaacggggtcctttcgacccatcctaccaagacgaacaacgaccaaagaattcaacttgtaatctaacgaactagaacagcctgggagaagtcgacgaagacgacggccgtagttattacgtgtgcgaagtagttaggtaaaggaaaaagtagtcggttagttggttaggtttaaggttcggggaacgaggggacgcccgtggttccgtaacccg

SEQ ID NO: 411241 - DNA, 634 bp, Homo sapiens
  misc_feature: GZ8MTXP01BF8D6.17.28.C06.1.454.CMB.2.raw
  modified_base (280)..(280): a, c, t, g, unknown or other
  modified_base (305)..(305): a, c, t, g, unknown or other
  modified_base (336)..(336): a, c, t, g, unknown or other
  modified_base (343)..(343): a, c, t, g, unknown or other
  modified_base (377)..(377): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtgggggtccctgagactctcctgtgcagcctccggattcccctnagtagttatggatgacttgggtccncagactccgaggggaggggctgggagtgggngaccaanataaagcaagatggaactgcccgtagttttacgnggactcgtagtgaacgggtccgtttacacctatcctccgagacaccaacgacccaaagaacttccacttagtactactaacaacttagaaaccagccctaggggaagtacggtccgacgaacggaccgaccgggtaccgttaggttaattaccgtggtgcgaagtattagggtaaaggaaaaagtagttggagtttggtttaggtttaagttacgggggccgtaaggggcgttccccggtaaggttccctaaccccg

SEQ ID NO: 411242 - DNA, 644 bp, Homo sapiens
  misc_feature: GZ8MTXP01EH06K.17.28.C06.1.454.CMB.2.raw
  modified_base (378)..(378): a, c, t, g, unknown or other
  modified_base (547)..(547): a, c, t, g, unknown or other
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgttgctgttttagaggtgtcagtgtgaggtcagttggtgaggtcggggagctggtccagccgtgggggtcctgagactctctgtgcagcctccggacttccccttcagttagttatggatgtacgttgggtccgcagactccgaggggaggggctgggagtgggtgaccaacataaagcaaagataggaactgtaccccgtagttttacgnggtactcgtaggtacggaacgggtcctttcacctatccgtaccagaacaacaaccgaccaaagtaacttcaacttagtaactactaacaacttacgaaactaacgcccgttaggggaagtacggtaccgacgaacgaaccgacggtccgttagttaacttcgtgtacgngaaagtagttaggtaaaggttaaaaagtagtggttagttggttaggttttaaggtgggggccgtagggggtacttcccggttgggttcctaaccccg

SEQ ID NO: 411243 - DNA, 747 bp, Homo sapiens
  misc_feature: GZ8MTXP01BYLEO.17.28.C06.1.454.CMB.2.raw
  modified_base (244)..(244): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcacgccacctcagtgtccgtcggggacccccggcaggacgggtcacctatatcttgttctaggaaacngctccggcatctacaactaactattttgctggtacagactaacttccgaggactcccggcccccactccctcactctaataagaatgactcgacgtccggccccgtccggggtccctcgaccccgtatttccgtcgtcggtcctaccagttcgttcccgtcgggaccctacccttccgaccggtccccttcccgtacgaacccgtacgttaccggtacgggttccggggtcccgttaccccgggggttaccggaagggtacgttacgggacggtaccgttagttaacgttttacgggtttacgttcggttaccgggtaccggtaacccgggggttaggtacgttacgggtaaccctcgtttacccgtaggtaacggtttcgggggtaacccggggttgggttccggggacggggttacgggaccggtcggttacccgttcgggttaccccgttaacgtacggtccgaacggtccccggaacgggtcccgttcccggtcccccg

SEQ ID NO: 411244 - DNA, 562 bp, Homo sapiens
  misc_feature: GZ8MTXP01A8D78.17.28.C06.1.454.CMB.2.raw
  modified_base (376)..(376): a, c, t, g, unknown or other
  modified_base (386)..(386): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattcccctcagtagttatggatgacttgggtccgccagactccgagggaaggggctgggagtgggtggccaacataaagcaagatggaaactgccccgtagttttacgnggactctagngaagggccgtttcaccatctaccagagacaacgccaaagattcatgtatacacaactgaacagcctaggagagtcgacagaccgacggccgtgtattctagtgcgaagattggtaaggaaaagtagtggagttggttgttaagttggggccgagggacgcccgtggttccgtcccg

SEQ ID NO: 411245 - DNA, 570 bp, Homo sapiens
  misc_feature: GZ8MTXP01BU80M.17.28.C06.1.454.CMB.2.raw
  modified_base (342)..(342): a, c, t, g, unknown or other
  modified_base (377)..(377): a, c, t, g, unknown or other
  modified_base (467)..(467): a, c, t, g, unknown or other
  modified_base (485)..(485): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctgggggtccctgagactctcctgtgcagccctccggattccccttcagtagttatggatgacttgggtccgccagactccgaggggaggggctggagtgggtggccaanataaagcaagatggaactgccccgtagttttacgnggactctgtgaagggcctttcaccatcctcagagacaacgccaagattcatgtatcacaactgaacagcctgggagagtccgacagaccncgggccgtagtattacgngtgcgaagtattggtaaggaaaagtagtggacttggttagtttaagtgggggcccagggggcgttcccgtgggttcctaaccccg

SEQ ID NO: 411246 - DNA, 619 bp, Homo sapiens
  misc_feature: GZ8MTXP01B9SJY.17.28.C06.1.454.CMB.2.raw
  modified_base (532)..(532): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtggggggtccctgagactctcctgtgcagccctcggacttccccttcagtagttatggatgacttgggtccgccagactccgaggggaaggggctgggaggtggggtggccaaacataaagcaaagataggaaactggacccccgtaggttttacgtggtactcgtaggtggaacggggtcccgtttacaccctatcctaccagacgacaacgaccaagacttcactagtatactaacaactagaaacagtccagggtagacgtcgcagacgacggtccgtagtattacgtgtcgngaagtattggtaaaggaaaaagtaagtggagttggttagtttaaggttcggggccgaaggggtccgcccgtggttccgtaaccccgg

SEQ ID NO: 411247 - DNA, 566 bp, Homo sapiens
  misc_feature: GZ8MTXP01EXGZ9.17.28.C06.1.454.CMB.2.raw
  modified_base (236)..(236): a, c, t, g, unknown or other
  modified_base (483)..(483): a, c, t, g, unknown or other
  modified_base (522)..(522): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccggcaggaggtcaccatatcttgtctgaaacngctccggcatctcaactaactatttttgctggtaccagcaacttcccgaggactccggccccccgactcctcatctataagaaatgatcacgtccggccccgtccggggtccctgaccccgtatttctctcggcctaccatcgtctcggccaccctcacgccctccctgacctatcgaggtcggcgtacccggtcgaggactggacgtctagtattacgttacgtgtcgcgtacggtggactgactntccgtagagtcgggtccggtggttccgggcggacggacnggcgttcgacccgtctagcgacgccgacgtccgttccgtccccg

SEQ ID NO: 411248 - DNA, 688 bp, Homo sapiens
  misc_feature: GZ8MTXP01C8T7Q.17.28.C06.1.454.CMB.2.raw
  modified_base (282)..(282): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgcttgttttagaaggtgtccagtgtgaggtccagttggttgaggtccggggaggcctggtccagcgtcgggggtccctgagctctcctgtgcagccctccggacttccccttnagtagttatggatgtacgttcgggtcccgccgagtactccggaaggggaaggggtcgtgggagggtgggtacgtaccaaactaagtaaaagacgaaagagtacggaactcggtaccccgttaggttttacggtggtacttcgtaggtacggtaacggggtccgttttaccaacctactcctaccgaagacgaacaacgaccaaagtaacttcaactagttaactactaaacaactagaacaacgccctaggggaacgagtaccgacgaagacccgacgggtccgttagtatttacgtgtcggagtaagtagttaaggtaaaggaaaagttaacgtggttacgtttggttaggttttaagggtcggggaaccgtaaggggcgttcccgttggttcccgttaaccccg

SEQ ID NO: 411249 - DNA, 654 bp, Homo sapiens
  misc_feature: GZ8MTXP01A3DBP.17.28.C06.1.454.CMB.2.raw
  modified_base (236)..(236): a, c, t, g, unknown or other
  modified_base (242)..(242): a, c, t, g, unknown or other
  modified_base (257)..(257): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggcagagggtcaccatatcttgttctggaaacngctcgnatctacaactaactntttgctgacagactactccgagctcccggcccctactcctctatactaatagaatgactcacgtccggcccgtccgggtcctacgaccgtcttctcgtcgtcctctaatcgtcgtcgccctacctcaccgtccctcctacgaccctacgtccggtacggtcgggtccgtacccgggtacggacggtagtacggacggtcttagtactttacgttacggtcggtacgtaccgtacgggtgggtactcgaacgttacgtcgtaggtacggttcggggttccgggttcgggttccggggacggggtacggaccggtacggtccgttaccggttacccggttaccgtaacggtcccgaaccggaccccgtacgggttccctaacccgggttcccccgttgg

SEQ ID NO: 411250 - DNA, 627 bp, Homo sapiens
  misc_feature: GZ8MTXP01A5XRL.17.28.C06.1.454.CMB.2.raw
  modified_base (276)..(276): a, c, t, g, unknown or other
  modified_base (373)..(373): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtccagtgtgaggtcagttggttgagtccggggagctggtccagccgtgggggtccctgagactctcctgtgcagccctccggattccccttnagtagttatggatgacttgggtccgcagactccgaggggaggggctgggagtgggtgccaacataaagcaagatggaactgccccgtagttttacgnggtactcgtagtggaacggggtcctttacaccgtatcctacagacgacaaacgccaaagtacttcactagtactctaacaactagaaacagtcctaggggacgtacgtcgacaggaccacgggtccgttagtacttacgtggtgacggaagtagttagggtaaaggaaaaagttacgtgggttacgtttggtttaggtttttaaggcgggggaacccgtaaggggcgttccccgttgggttaacccgtccccgg

SEQ ID NO: 411251 - DNA, 548 bp, Homo sapiens
  misc_feature: GZ8MTXP01BM3EB.17.28.C06.1.454.CMB.2.raw
  modified_base (489)..(489): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagcccaccctcagtgtctgggacccccgggcagagggtcaccatatcttgttctggaaacagctccggcatctacaactaaactatttttgctggtaccagcaaattcccaggactccggccccccgactcctcatctatagaaatgatcatccggccctccggggtccctgaccgacttctctggcctccaatgtctggcctacctcacgccctccctgacccatcaggtcgggcctccgggtccgaggatgaggctgatttatacgtgtgcaccggtggatgacatcctgatgggtccggtggttccgggngggacgggccgaggcttcggcccgttcgtaagtcaacgcccgaggcctcgcccccgtgg

SEQ ID NO: 411252 - DNA, 622 bp, Homo sapiens
  misc_feature: GZ8MTXP01DCGDI.17.28.C06.1.454.CMB.2.raw
  modified_base (240)..(240): a, c, t, g, unknown or other
  modified_base (550)..(550): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtccgtcgggacccccggcagagggtcaccatatcttgttctggaaacngctcggcatctacaactaaactatttttgctaggtaccagcaattcccaggactccggcccccgactcctcatctatagaaatgatcatccggccccgtccggggtccctcgaccccgtattcctcgtgcctccatcgtctcggccacctccacgcccctccctgaccatcgagtcgggccctccgggtccgaggtactggacgggcttagtatttagttacgtggtagtccgaaccggtgggattggaaccagttcccgtaggtaacgttcgggtcccgggttggttcggggccgggaggggtacccgngggttaccgttcggttacccgtcccgtaaaggtccacgggaccccgaagggtcccgttccgggtcccccccg

SEQ ID NO: 411253 - DNA, 561 bp, Homo sapiens
  misc_feature: GZ8MTXP01CI2JN.17.28.C06.1.454.CMB.2.raw
  modified_base (205)..(205): a, c, t, g, unknown or other
  modified_base (232)..(232): a, c, t, g, unknown or other
  modified_base (238)..(238): a, c, t, g, unknown or other
  modified_base (252)..(252): a, c, t, g, unknown or other
  modified_base (263)..(263): a, c, t, g, unknown or other
  modified_base (274)..(274): a, c, t, g, unknown or other
  modified_base (281)..(281): a, c, t, g, unknown or other
  modified_base (294)..(294): a, c, t, g, unknown or other
  modified_base (297)..(297): a, c, t, g, unknown or other
  modified_base (301)..(301): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccacctcagtgtcgtcgggaccccggnagaggtcacatatcttgtctggaaacngctcgnatctacaactaatntttgctgacanacactccagcnccgcccnctctcatactaanaanaatnactcacgtccggccgtccggtcctcgactacttctcgtcgtctcatcgtctcgcacctcactcctccacactactcgacggtcggtccgtccgacgagatggagtctagtattagtacgtcgtcgaccgtacggtgtactcgtactacgtcgtagtacgttcgggtccggtcgggtacgggcgggtacggaccgtacggtcgttacggttaccgttacgtaacgccgaacgacccgtacgttcccgtccgttccccgtcg

SEQ ID NO: 411254 - DNA, 672 bp, Homo sapiens
  misc_feature: GZ8MTXP01DCE82.17.28.C06.1.454.CMB.2.raw
  modified_base (208)..(208): a, c, t, g, unknown or other
  modified_base (236)..(236): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctccaccctcctcactcactgtgcagggtcctgggcccagtctgtgctgactcagccaccctcagtgtcgtcgggaccccggnagaggtcacatatcttgttctggaaacngctccggcatctacaaactaaactattttgctcggtaccagactaaacttcccgaggtactccggcccccccgactccctctatactaataacgaaatgacttcacgtccggccccgttccgggggtccctacggaccccgtactttctcgtcggtcctacccattcgtctcggaccctaccctcacgtccctcccgtacgaccatcgaggtcgggcccgtaccgggtccgaggactggacgtctagtaactttacttacgtggttcgaccggtaccggttggactcgtactcgttcccgtaggacgttcggggttccgggttcggttaccgggggacgggaacggggtcccgtaaggggttccgttacgggttacccgttaacccggtaagtcccgacggtaccccgttaagggtcccgttcccggtccccccgg

SEQ ID NO: 411255 - DNA, 597 bp, Homo sapiens
  misc_feature: GZ8MTXP01A6RHL.17.28.C06.1.454.CMB.2.raw
  modified_base (210)..(210): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcgagggtcctgggcccagtctgtgctgactcagcccaccctcagtgtcgtcgggacccccggnagagggtcaccatatcttgttctaggaaacagctccggcatctacaaactaaactattttgctggtaccagcaacttcccgaggactcccggacccccgactcctcatctaataagaatgatcacgtccggcccgttccggggtccctcggacccctattctcgtcggcctaccatcgtcgtcggccacctcacgtccctccctacgaccatcgaggtcgggccgtcccgggacgaggactggagtctagtattacgtactggtcgacgtacggtggatcgaactcttccgagtaacgttcgggtccggtgggttccgggacgggacgggaccgaggccgttcggacccgtcgtaacgccgacgcccgagtcccgttcccgtccccg

SEQ ID NO: 411256 - DNA, 587 bp, Homo sapiens
  misc_feature: GZ8MTXP01DEPRH.17.28.C06.1.454.CMB.2.raw
  modified_base (385)..(385): a, c, t, g, unknown or other
  modified_base (464)..(464): a, c, t, g, unknown or other
  modified_base (469)..(469): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgctgttttagaaggtgtccagtgtgaggtccagttggttgaggtccgggggagcctggtccagccgtgggggtccctgagactctcctgtgcagccctccggattccccttcagtagttatggatgacttgggtccgccagactccgaggggaaggggctgggagtggggtggaccaacataaagcaaagatggaactgccccgtagttttacgnggactcgtagtgaacgggcctttcacctatctccaagacgacaaacgaccaaagtaattcactagtactctaacaactnaacancctgagagtcgcagacgacggccgtagtattacgtgtgcgaagattaggtaaggaaaaagtaagtggacgttgttagtttaagttggggccgaggggacgcccgtggttcctaacccg

SEQ ID NO: 411257 - DNA, 631 bp, Homo sapiens
  misc_feature: GZ8MTXP01DT6V1.17.28.C06.1.454.CMB.2.raw
  modified_base (278)..(278): a, c, t, g, unknown or other
  modified_base (465)..(465): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagccgtgggggtccctgagctctcctgtgcagccctccggattccccttnagtagttatggatgacgttgggtccgccagactccgaggggaaggggctgggagtgggtaggaccaaacaataaaaacaagagtaggaactgccgtagttttacgtggacttcgtgtaggaagggtcccgtttcaccatcctccagagacaacgaccaaagtatcactgtactctaacaactgaacngcctgaggagtcgcaagaccgacggtccgtagtaacttacgtgtagcgagtaagttaggttaagggtaaaaacgttagtagggtcttgggtttaggttttaacggttgggggtaccgtaacgggggtcgtccccggttaggggttccccttaacccgggtttcccg

SEQ ID NO: 411258 - DNA, 668 bp, Homo sapiens
  misc_feature: GZ8MTXP01DSYH5.17.28.C06.1.454.CMB.2.raw
  modified_base (277)..(277): a, c, t, g, unknown or other
  modified_base (349)..(349): a, c, t, g, unknown or other
  modified_base (398)..(398): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactggttttcctgttgctgttttagaggtgtccagtgtgaggtccagttggttgaggtccggggagcctggtccagccgtgggggtccctgagactctcctgtgcagccctccggattccccctnagtagttatggatgacgttgggtcccgccagactccggaaggggaaggggctgggagtggggtcgacccaanaagtaaaagcgaaagagtaggaaactcggaccccgttaggtttttacgnggtacttcgtagggtaggtaacggggtccctttaccaacctatcctaccgaagacgaaccaacgaccaaagtaacttcacttagtactactaacaactacgaacacgacctgggaacgcgtaccgacgacggaccgacggtaccgttagttaacttcgtagtcggcgaagtagttagggtaaaggttaaaaagttagtggttacgtttgggttaggtttaacgggttcggggccgtagggggacttcccggttggttcccgttaacccgg

SEQ ID NO: 411259 - DNA, 583 bp, Homo sapiens
  misc_feature: GZ8MTXP01DTNR4.17.28.C06.1.454.CMB.2.raw
  modified_base (277)..(277): a, c, t, g, unknown or other
  modified_base (379)..(379): a, c, t, g, unknown or other
  modified_base (413)..(413): a, c, t, g, unknown or other
  modified_base (505)..(505): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggagcctggtccagcgtgggggtccctgagactctcctgtgcagccctccggattccccttnagtagttatggatgacttgggtccgccagactccgaggggaaggggctgggagtgggtggccaacataaagcaaagatggaactgaccccgtagttttacgnggactcgtgtgaagggcctttcaccatctcaganacaacgaccaagaatcactagtatctaacaactagaacagccctaggagacgtacgcgagaccacgggccgtagtacttacgtgtcgcgaanagttaggtaaggaaaaagtagtggttacttggttagtttaaggtggggccgagggacgttcccgtggttcctaacccg

SEQ ID NO: 411260 - DNA, 520 bp, Homo sapiens
  misc_feature: GZ8MTXP01DVPUG.17.28.C06.1.454.CMB.2.raw
  modified_base (272)..(272): a, c, t, g, unknown or other
  modified_base (276)..(276): a, c, t, g, unknown or other
  modified_base (349)..(349): a, c, t, g, unknown or other
  modified_base (372)..(372): a, c, t, g, unknown or other
  modified_base (438)..(438): a, c, t, g, unknown or other
  modified_base (504)..(504): a, c, t, g, unknown or other
  modified_base (511)..(520): a, c, t, g, unknown or other
tcagcgtagactagcacgaccggtgctcgatttagagctcacgtattgggtttgggggggtgtggtggtctccactcccgcccagtctgtgctgactcagcccaccctcagtgtctcgggacccccgggcagagggtcaccatatcttgttctggaaacagctccggcatctcaactaaactatttttgctggtaccagcaattcccaggactccggccccccgatcctcatctatagaaatgatcatcggccctccggggtccctgaccgnttcnctggctccatgctggcacctcagccctccctgacccatcagtggctccggtcgaggatgaggctgattatacngtcgcacgtgggatgaacatccngaatgggtccggtggttcgggcggtacgggaccaggctggaccgtcctaagtcgacgcccaaggcncgccccctggtccacgtctcgtcccaccctcctcctacgtctacgctgacgcggcgtgcgaaggcncgaatgnnnnnnnnnn

SEQ ID NO: 411261 - DNA, 681 bp, Homo sapiens
  misc_feature: GZ8MTXP01BMF33.17.28.C06.1.454.CMB.2.raw
  modified_base (240)..(240): a, c, t, g, unknown or other
  modified_base (248)..(248): a, c, t, g, unknown or other
  modified_base (264)..(264): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtcgtcggggacccccgggcagagggtcaccatatcttgttctaggaaacngctccggnatctacaactaaactnttttgctggtaccagactaacttcccaggactcccggccccccgacttccctacatcctaataagaaatgactcacgtcccgggccccgttcccgggggtccctggaccgtacttcctcgtcggccctccaacgttcgtcgtcgggaccctacctccaccggtcccccttaccctcgaccctacgtccgtacgggtcggggtacccttccgggtacccggaggtacttacgggacggtccgttaaggtaattttacgtaacgggtttcggtcggtccgtaaccgggttgggaatcgaacctacgttaccgtagtaacggtcgggttccgggtcggttcggggacgggtacggcgacggtcgttacggttacccgttaccgtaagtcgaacgccccgtaggcctcccgttccccgtcg

SEQ ID NO: 411262 - DNA, 563 bp, Homo sapiens
  misc_feature: GZ8MTXP01DPNKW.17.28.C06.1.454.CMB.2.raw
  modified_base (207)..(207): a, c, t, g, unknown or other
  modified_base (236)..(236): a, c, t, g, unknown or other
  modified_base (260)..(260): a, c, t, g, unknown or other
  modified_base (360)..(360): a, c, t, g, unknown or other
  modified_base (397)..(397): a, c, t, g, unknown or other
  modified_base (403)..(403): a, c, t, g, unknown or other
  modified_base (424)..(424): a, c, t, g, unknown or other
  modified_base (459)..(459): a, c, t, g, unknown or other
  modified_base (463)..(463): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtgggacccccggnagaggtcaccatatcttgttctagaaacngctccggcatctcaaactaaactnttttgctaggtaccagcaaacttcccaggactccggccccccatcctcatctaatagaaatgattcgagtccggcccctccggggtccctgaaccccgtnttcgctcggcctccatcgtctggcactcagccctccngaccancgtacgtcggctccggtcagntacgagcgtattattagttacgtgtgacgcgtagngtanctacgtactcgtacggtgtcggtcgggttcggacgggacggtacgtacgttcggttcgttaccgtaaccgtactaacgtcgacgaccgcgttccgtcccg

SEQ ID NO: 411263 - DNA, 619 bp, Homo sapiens
  misc_feature: GZ8MTXP01DN9WA.17.28.C06.1.454.CMB.2.raw
  modified_base (277)..(277): a, c, t, g, unknown or other
  modified_base (340)..(340): a, c, t, g, unknown or other
  modified_base (379)..(379): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgcttgttttagaaggtgtccagtgtgaggtcagttggttgaggtcggggagcctggtccagccgtgggggtcctgagactctcctgtgcagcctccggacttcccctnagtagttatggatgacgttggtccgcagactcgaagggaggggctgggagtgggtgaccaaanaataaaagcaaagataggaaactgcccgtagttttacgnggtactcgtaggtagaacggggtcctttacaacctatcctaccagacgaacaacgacaaagaattcaactagtatactaacaaactagaaacagtccgtaggggaagaggtaccgacgaacgaccgacgggtccgttagttatttacgtgtcggagtaagtagttagggtaaagaaaaaagttaacgtgggttattggttggtttaaggtgggcgtaaggggcttcccgtggcctaaccg

SEQ ID NO: 411264 - DNA, 585 bp, Homo sapiens
  misc_feature: GZ8MTXP01BJP4Q.17.28.C06.1.454.CMB.2.raw
  modified_base (382)..(382): a, c, t, g, unknown or other
  modified_base (507)..(507): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggagcctggtccagccgtgggggtccctgagactctcctgtgcagccctccggattccccttcagtagttatggatgacttgggtccgcagactccgaggggaaggggctgggaggtggggtggaccaacaataaagcaaagatggaactgccccgtagttttacgnggactcgtagtagaaggggtcccgttttcaccgtatctaccaagacacaacgaccaaagaatcactagtatactacaactgaacagcctggagagtcgacagacgacggctagtattactgtcgngaagtagttggtaagaaaaagtagtggacgttgttaggtttaagtcggggcaggggacttcccgtgttccgtaacccg

SEQ ID NO: 411265 - DNA, 631 bp, Homo sapiens
  misc_feature: GZ8MTXP01ETZ2P.17.28.C06.1.454.CMB.2.raw
  modified_base (387)..(387): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggagcctggtccagccgtgggggtccctgagactctcctgtgcagcctccggacttcccctcagtagttatggatgacgttgggtccgccagactccgaggggaggggctggaggtgggtgaccaagaataaagacaaagataggaactggtaccccgtaggttttacgngggtacttcgtaggtacggaacggggtcccgttttacaccctattcctaccgaaggacgaaccaaccgaccaaagtattcacttagtactactaacaattcgaaacacgcctgggaacgtgtcgacaagcgacgggtcctagtacttacgtgtgcgaagtagttaggaaaggttaaaagtagtcgggttattggttagttttaaggcgggggcctagggggacttcccgtggttcctaacccgg

SEQ ID NO: 411266 - DNA, 608 bp, Homo sapiens
  misc_feature: GZ8MTXP01AVIYW.17.28.C06.1.454.CMB.2.raw
  modified_base (300)..(300): a, c, t, g, unknown or other
  modified_base (374)..(374): a, c, t, g, unknown or other
  modified_base (410)..(410): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgttgctgttttagaaggtgtcagtgtgaggtcagttggttgagtccgggggagcctggtccagccgtgggggtccctgagactctctgtgcagcctccggattccccttcagtagttatggatgacttgggtccnccagactccgagggaggggctgggagtgggtgccaacataaagcaagatggaaactgaccccgtagttttacgnggactctgtgaagggtccgtttacaccatctcaganacaaacgccaaagaattcaactgtactactacaaactgaaacacgcctagggagtagtcgacaaggcgtacggccgttgtattacgtgtacgcgaagtagttaggtaaagggaaaaaagttaagtggggacttgggttaggttttaaggttcgggggaaccagggggaccgttcccggttaagggttccctaacccgg

SEQ ID NO: 411267 - DNA, 650 bp, Homo sapiens
  misc_feature: GZ8MTXP01B508N.17.28.C06.1.454.CMB.2.raw
  modified_base (207)..(207): a, c, t, g, unknown or other
  modified_base (237)..(237): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggnagagggtcaccatatcttgttctggaaacngctccggcatctacaactaaactatttttgctggtaccagcaacttcccaggactccggccccccactcctcatctataagaatgactcacgtccggccccgtcccggggtcctcgaccccgtacttctcgtcggcctaccattcgtctcgggccctacctccacgtcccctccctacgacctagtcgacggtcgggcccgtcccgggtaccggaggacgtcggaggtcttagtaactttacggttaacgttggtacgccgtaaccgggttggggaatcggaactacgttccgtaggtaacgttcggggtcccgggttggttccgggggcggaggggacccgtagggcgttcggttacccggtaaccttaaggccgaacggtacccgaacgggtcccgttcccggtccccccg

SEQ ID NO: 411268 - DNA, 692 bp, Homo sapiens
  misc_feature: GZ8MTXP01DOAAC.17.28.C06.1.454.CMB.2.raw
  modified_base (574)..(574): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgctgttttagaaggtgtccagtgtgaggtccagttggtgaggtccggggagcctggtccagccgtgggggtccctgagctctcctgtgcagccctccggacttcccctctagttagttatggatgtacgttcggtcccgcagacgtccgaggggaggggctgggaggtgggtcggaccaaacgaagtaaacgacaaagagtacggaaacttcggtaccccggttaaggttttacggtcggtacttcgtaaggtacggtaacggggtcctttaccgaacctactcctaccgaagaacgaaccaacggaccaaagtactcaattagtactacctaacaaactacgaaacacgcctaggggacgtacgtacgacgaacgacccgacggtccgttagtaacctttagnggtccgagggtaaatgttaagggtaaaacggttaaaaaagttaacgtggttaagttggtttacggtttaagggtcgggggaaccgtaggggaccttccggttcggttcctaaccccgg

SEQ ID NO: 411269 - DNA, 718 bp, Homo sapiens
  misc_feature: GZ8MTXP01B1MB4.17.28.C06.1.454.CMB.2.raw
  modified_base (276)..(276): a, c, t, g, unknown or other
  modified_base (402)..(402): a, c, t, g, unknown or other
  modified_base (600)..(600): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtcagtgtgaggtcagttggttgaggtccggggagcctggtccagccgtgggggtccctgagctctcctgtgcagccctccggattccccctnagtagttatggatgtacgttgggtcccgccagactccggaaggggaaggggcgtgggaggtggggtacggaccaaacaagtaaaagacaaagatagggaactcggaccccggttaggtttttacgnggtacctcgttaggagggtaaccggggtcccttttacgaaccctagttcctacccgaaggtaacgaacccaaaccgccaaaagtaacttactaacttagttaactacctaaaccaaccgttagaaaccagcctagggaacggtagtccgacgaacgaaccgaccgggtcccgttaggttaactttaccgtggttccgnggtaagtaagttaagggtaaaggttaaaaaagtacgtggttacgttgggtttacggttttaagggtcgggggtaacccgagggggtaccgttcccggtaacggggttcctaaccccgg

SEQ ID NO: 411270 - DNA, 598 bp, Homo sapiens
  misc_feature: GZ8MTXP01CFVIY.17.28.C06.1.454.CMB.2.raw
tcagcgtagactagcacgaccggtgctcgatttagagctcacgtattgggtttggggagcttcagctgtggtagagaagacaggattcaggacaatctccagcatggccggcttccctctcctcctaaccctcctcactcactgtgcagggtcctgggcccagtctgtgctgactcagccaccctcagtgtctgggacccccggcagagggtcaccatatcttgttctaggaaacagctccggcatctacaaactaaactatttttgctggtaccagcaattcccaggactccggccccccgatcctcatctaatagaaatgatcatccggcccgtccggggtcctgaccgattcctctggctcatcgtctggcacctcagccctcctgaccatcgaggtcgggccgtccggtccgaggtatgacggtctgtattattacgtgggtcgccgtaccggtgggtatcggactacgttccgtagtaagttcgggtaccgggtggttcgggcgggttaagggacccgagggtctcggacccgttccgttaaagtcccgacgtccccgaaggtcccgttccgtcccccgttcgggttaacccc

SEQ ID NO: 411271 - DNA, 585 bp, Homo sapiens
  misc_feature: GZ8MTXP01DM2UM.17.28.C06.1.454.CMB.2.raw
  modified_base (276)..(276): a, c, t, g, unknown or other
  modified_base (469)..(469): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagctgggggtccctgagactctcctgtgcagccctccggattcccctnagtagttatggatgacttgggtccgccagactccgaaggggaaggggctgggagtgggtggccaaacataaaagcaaagatggaactgccccgagttttacgtggactctagtgaagggtcctttcacccatctccagagacaacgccaagaattcactgtatactacaactgaaacagccctgggagagtcncaagaccacggccgtagtattacgtgtcgcgaagaattggtaggaaaaaaagttagtgggttacttggttagttttaagttgggggccaggggagttcccgtggttccgtaacccg

SEQ ID NO: 411272 - DNA, 604 bp, Homo sapiens
  misc_feature: GZ8MTXP01DU93M.17.28.C06.1.454.CMB.2.raw
  modified_base (280)..(280): a, c, t, g, unknown or other
  modified_base (387)..(387): a, c, t, g, unknown or other
  modified_base (503)..(503): a, c, t, g, unknown or other
  modified_base (523)..(523): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggagcctggtccagccgtgggggtccctgagactctcctgtgcagccctccggattccccttnagtagttatggatgacttgggccgccagactccgaaggggaaggggctgggagtggggtgaccaaacagtaaaagcaaagatggaaactgaccccgtagttttacgnggtactcgtaggtgaacggggtccctttacgacctatcctaccaagacgaacaacgaccaaagtattcaactgtaatactaacaaactgaaacagcctagggagagtcgacagacncggcttagtattacgtgtgngaagtagttaggtaaggaaaagtaagtggttacgttggttaggtttgtgggtcggagggacgcccgtcggttcgtaacccg

SEQ ID NO: 411273 - DNA, 685 bp, Homo sapiens
  misc_feature: GZ8MTXP01DRZFV.17.28.C06.1.454.CMB.2.raw
  modified_base (271)..(271): a, c, t, g, unknown or other
  modified_base (277)..(277): a, c, t, g, unknown or other
  modified_base (294)..(294): a, c, t, g, unknown or other
  modified_base (316)..(316): a, c, t, g, unknown or other
  modified_base (327)..(327): a, c, t, g, unknown or other
  modified_base (364)..(364): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagcctggtccagccgtgggggtcctgagactctctgtgcagcctcgattcccctnagtatntggatgacgttggtccncagactccgagggagggctggngtggtgccaanataaagcaagataggaactggacccgtagttttacgnggactcgtggtagtaaggggtcctttcgaaccatcctacgaaggacgaaccaaacggacccaaagtaactttaccaacgttagttaacttaccttaaacaaaccgttaacggaaaccaaacggtccccgttaagggggaaacggtacggtacccggacgaaacgaaccccggtacccgggtaccgttaggttaaacgtttaaccgtggttacggaccggtaagtaagttaggtaaaagggttaaaaaagttaacgtggttacgtttggttagttttaagggtcggggccgtaggggaccttccgtcgggttcctaaccccg

SEQ ID NO: 411274 - DNA, 621 bp, Homo sapiens
  misc_feature: GZ8MTXP01CC2S4.17.28.C06.1.454.CMB.2.raw
  modified_base (336)..(336): a, c, t, g, unknown or other
  modified_base (380)..(380): a, c, t, g, unknown or other
  modified_base (464)..(464): a, c, t, g, unknown or other
  modified_base (475)..(475): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagccgtgggggtccctgagactctcctgtgcagccctccggacttccccttcagtagttatggatgacttgggtccgcagactccgaggggaggggctgggagtgggngaccaacataaagcaagataggaactgaccccgtagttttacgnggactcgtgtagaacgggtccctttcaccatcctccagacgaccaacgccaaagacttcactagtactactaacaactgaaacngccctaggagngtccgacacgaccgacggtccgttagtacttaccgtgtcgcggtaagagttagggtaaggttaaaaagttagtgggttacgttggtttggtttaagggttcgggggaaccgtagggggtacgccccgttgggttccctaaccccgg

SEQ ID NO: 411275 - DNA, 568 bp, Homo sapiens
  misc_feature: GZ8MTXP01C07H8.17.28.C06.1.454.CMB.2.raw
  modified_base (338)..(338): a, c, t, g, unknown or other
  modified_base (372)..(372): a, c, t, g, unknown or other
  modified_base (450)..(450): a, c, t, g, unknown or other
  modified_base (469)..(469): a, c, t, g, unknown or other
  modified_base (547)..(547): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagctggtccagctgggggtccctgagactctcctgtgcagccctccggattccccttcagtagttatggatgacttgggtccgccagactccgaggggaggggctgggagtgggtgccaanataaagcaaaatggaaactgccgtagttttacgnggactctgtagaagggtcccgtttcacctatctaccagagacaacgccaaagaattcactgtatactacaactgaacngcctgaggagtcgcagacncggccgtgtacttacgtgtagcgagaatgttaggaaaagttagtggcttggttgtttagtcgggggaccaaggggacnccgttaggtccaaccggtccc

SEQ ID NO: 411276 - DNA, 612 bp, Homo sapiens
  misc_feature: GZ8MTXP01C9DL6.17.28.C06.1.454.CMB.2.raw
  modified_base (383)..(383): a, c, t, g, unknown or other
  modified_base (393)..(393): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggagcctggtccagccgtgggggtccctgagactctcctgtgcagccctccggacttccccttcagtagttatggatgacgttcgggtccgccagactccgaggggaaggggctggagtgggtgaccaacataaagcaagataggaactgccccgtagttttacgnggtactctgngaagggtcctttcacctatcctacagacacaacgaccaaagattcactgtactctaacactcgaacagcctagggacgacgtcgacagaccgacggtccgttagttacttacgtgtgcggaagtaagttaggtaaaggaaaaaagttagtggttacgttggtttaggttttaaggtggggaacccgtaggggacgttcccgttggttcccgttaacccg

SEQ ID NO: 411277 - DNA, 602 bp, Homo sapiens
  misc_feature: GZ8MTXP01BMAN0.17.28.C06.1.454.CMB.2.raw
  modified_base (278)..(278): a, c, t, g, unknown or other
  modified_base (334)..(334): a, c, t, g, unknown or other
  modified_base (377)..(377): a, c, t, g, unknown or other
  modified_base (457)..(457): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggctggtccagcgtgggggtccctgagactctcctgtgcagccctccggattccccttnagtagttatggatgacttgggtccgccagactccgaggggagggctgggagtgggngaccaacataaagcaagataggaactggcccgtagttttacgnggactcgtgtggaagggtccgtttcaccatcctccagacacaacgccaaagacttcacttagtatctaacaactgaaacngcctggggagagtcgacagaccgcggtccgtgtacttacgtgtggacgaagtagttagggtaaggaaaaagtagtggttcgttggttagtttaagggttcgggggaaccgtagggggacgttccccgttgggttccgtaaccccg

SEQ ID NO: 411278 - DNA, 717 bp, Homo sapiens
  misc_feature: GZ8MTXP01A5H8P.17.28.C06.1.454.CMB.2.raw
  modified_base (187)..(187): a, c, t, g, unknown or other
  modified_base (237)..(237): a, c, t, g, unknown or other
  modified_base (244)..(244): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccacctnagtgtcgtcgggacccccggaggaggtcaccatatcttgtctaggaaacngctcggnatcacaactaactattttgctggtaccagctaattcccgaggactcccggcccccgatcctcatctaataagaaatgactcgacgtccggccccgttccggggtcctcgacccccgtatttcgtcgtcggcctaccgattcgtctcgggaccctaccctcgaccgtcccttcccgtagaccctagtcggacgggtcggggtccctacccgggtaccggtaggtaacgttcggaacggtccttaagggttaacctttaaggtttaccggtggttccgggaccgtaccggggtgggtacttacgggaaacttcgtacccggttaggtaaccggttcgggggtccggtttggggttaccggggacgggttacgggaaaccgtcggggttcccgttaccgggttaacccggttaaccgttaaacggtcccgaacccggaccccgttaacgggtccccgttccccggttccccccggg

SEQ ID NO: 411279 - DNA, 608 bp, Homo sapiens
  misc_feature: GZ8MTXP01DF70P.17.28.C06.1.454.CMB.2.raw
  modified_base (207)..(207): a, c, t, g, unknown or other
  modified_base (233)..(233): a, c, t, g, unknown or other
  modified_base (412)..(412): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggnagaggtcacatatcttgtctgaaacngctccggcatctacaactaaactatttttgctggtaccagctaacttcccaggactccggcccccgactcctcatctaatagaaatgactcacgtccggccccgttccgggggtccctcgtaccccgtacttctcgtcggtcctccctatgtctcgggcctacctcacgtcccttcccncgaccctattcgaggtcgggtccgtccgggtccgaggtactggaacggtcttagtatttaggttacgtggttcgacgtaccggtgggatggactactccgtagacgtcgggtcggtggttcgggcgggacggaccgcggttcgttcggacccgttcgtaaagcgaccgcccggttaacgtcccgttccgtcccccg

SEQ ID NO: 411280 - DNA, 565 bp, Homo sapiens
  misc_feature: GZ8MTXP01B57JP.17.28.C06.1.454.CMB.2.raw
  modified_base (553)..(553): a, c, t, g, unknown or other
  modified_base (555)..(565): a, c, t, g, unknown or other
tcagcgtagactagcacgaccggtgctcgatttagagctcacgtattgggtttggggggtgtggtggtctccactcccgcccagtctgtgctgactcagccaccctcagtgtctgggacccccgggcagagggtcaccatatcttgttctggaaacagctccggcatctcaactaaactatttttgctggtaccagcaattcccaggactccggccccccgatcctcatctatagaaatgatcatccgccctccggggtcctgaccgattctctggctccatgctggcacctcacgcctccctgaccatcagtggctccggtcgaggatgagctgattatactgtcgcgacggtgggatgaacactccgtgtaacgttcggggttccggttggttcggggacgggagggacccgagggccgtcgaccgtcgtaacgtacacggacccgaacggcctccgcccccgtacggtcctaccgtcttccgttcccctaccctccctcctacgtccgtacgtcgtcggacggccggcgtcggcgaacggccgcgagtgngnnnnnnnnnnn

SEQ ID NO: 411281 - DNA, 572 bp, Homo sapiens
  misc_feature: GZ8MTXP01D9YMM.17.28.C06.1.454.CMB.2.raw
  modified_base (374)..(374): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggagcctggtccagcctgggggtccctgagactctcctgtgcagcctccggattccccttcagtagttatggatgacttgggtccgcagactccgaggggaggggctgggagtgggtggccaacataaagcaagatggaactgccccgtagttttacgngactctagtgaagggtcctttcaccatctccagacgacaacgccaaagaacttcaacttagtactctaacaactgaaacagcctaggagagtcgcagacacggcgtagtattactgtgcgaagattggtaagaaaagtatggttacgttggttcgtttaagtgggggcctaggggacgccgtgggttccctaacccgg

SEQ ID NO: 411282 - DNA, 584 bp, Homo sapiens
  misc_feature: GZ8MTXP01CMQBE.17.28.C06.1.454.CMB.2.raw
  modified_base (282)..(282): a, c, t, g, unknown or other
  modified_base (306)..(306): a, c, t, g, unknown or other
  modified_base (346)..(346): a, c, t, g, unknown or other
  modified_base (380)..(380): a, c, t, g, unknown or other
  modified_base (536)..(536): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggcggaggcctggtccagccgtggggggtccctgagactctcctgtgcagccctccggacttcccctnagtagtatggatgacttgggtccncagactccgaggggaagggctgggaggtgggtggccaaanagtaaagcaagatggaactgaccgtagtttacgnggactcgtgtgaacgggtccgtttcaccgatctcagagacaacgaccaagattcacttagtactactaacaactagaaacacgccgtagagacgtacgacacgacgacggccgtagtactacgtgtgcgaagagtagaaggaaaagtagttggttnttggttggtttagtcgggggaccgaggggccgtccgttcggtaacccg

SEQ ID NO: 411283 - DNA, 685 bp, Homo sapiens
  misc_feature: GZ8MTXP01APD50.17.28.C06.1.454.CMB.2.raw
  modified_base (370)..(370): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagctggtccagccgtgggggtcctgagactctcctgtgcagcctccggattccccttcagtagttatggatgtacttgggtccacagactccgagggaaggggctggagtgggtgaccaacataaagcaagatggaactgcccgtagtttacgnggactcgtagtaggaacgggtccgtttccacctatcctaccgagacgaaccaaacggacctaaagaacttacaacttgtacttactaaccgaactagaaacagtccctaggggaagtacgtccgacgaacgacccgtaccggggtacccgttagttaatttaccggtggttacggacggtaaagtaagtttagggtaaacggggttaaaaaaagttaaggttcggggttacgtttgggttacgggtttttaagggttcggggggaaccctaaaggggggccttccccgggttaaggggttccccttaaccccggg

SEQ ID NO: 411284 - DNA, 770 bp, Homo sapiens
  misc_feature: GZ8MTXP01BHV3U.17.28.C06.1.454.CMB.2.raw
  modified_base (281)..(281): a, c, t, g, unknown or other
  modified_base (420)..(420): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagccgtgggggtccctgagactctcctgtgcagccctccggacttcccccttnagtagttagtggatgtacgttgggtccgccagactccggaggggaacggggctggggaggtgggggtacggaccaaacgtaaagtaaaacgacgaaagtaagtacggaaactcggtacccccggttaaggtttttacgngggtaaccttcgtaaggtacgggtaacggggtcccgtttaccacctagttcctacgaaagtacgaaaccaaaccggaccaaagtaacttacaacgttagtaaactacttaaacaaacccgttagaaacctacgtacccgttaggggaacggtaacgtcccgaccgtaaacggaaacccggccggggttacccgttaagggtttaacttttaaccggtggttacgggcgggtaaagtaaggttaagggttaaaagggaaaaaaagttacggtgggttacgtttggtttagggtttaaggttcgggggaaccgtagggggaccttccccggttgggttcccgttaaccccgg

SEQ ID NO: 411285 - DNA, 563 bp, Homo sapiens
  misc_feature: GZ8MTXP01BXUL8.17.28.C06.1.454.CMB.2.raw
  modified_base (207)..(207): a, c, t, g, unknown or other
  modified_base (474)..(474): a, c, t, g, unknown or other
  modified_base (513)..(513): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggnagagggtcaccatatcttgttctggaaacagctccggcatctacaaactaaactattttgctggtaccagcaacttcccaggactccggcccccactcctcatctataagaaatgatcacgtccggccctccggggtccctgaccccgtattctcgtgctccatcgtctcggccacctcacgccctccctgaccatcgagtcgggcctcccgggtcgaggctggacgtctagtatttacgttacgtgtcgcgtacgtgggatgactntccgtgtacgtgggtccggtggttcgggcggaggaccgngggttacgttcgaccgtctaagccgacgcccgttaggccttcgtcccccg

SEQ ID NO: 411286 - DNA, 601 bp, Homo sapiens
  misc_feature: GZ8MTXP01B75XW.17.28.C06.1.454.CMB.2.raw
  modified_base (456)..(456): a, c, t, g, unknown or other
  modified_base (471)..(471): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtgggggtccctgagactctcctgtgcagccctccggattccccttcagtagttatggatgacttgggtccgccagactccgagggaaggggctgggagtgggtgccaacataaagcaagatggaactgccccgtagttttacgtggactcgtagtgaaggggtccctttcaccatcctcagagacaacgccaaagattcactagtatctaacaactgaacngcctgggaagtgtcncagaccgacggccgttagtacttacgtgtgcgaagtagttaggtaagggaaaaagttagtgggcgttgggttcggttttaaggtcgggggaaccgaagggggtccgttcccgttgggttcccgtaacccg

SEQ ID NO: 411287 - DNA, 640 bp, Homo sapiens
  misc_feature: GZ8MTXP01BT6V3.17.28.C06.1.454.CMB.2.raw
  modified_base (278)..(278): a, c, t, g, unknown or other
  modified_base (302)..(302): a, c, t, g, unknown or other
  modified_base (384)..(384): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggttgagtccggggagcctggtccagccgtggggggtccctgagactctcctgtgcagcctccggattccccttnagtagttatggatgactgggtccnccagactccgagggaggggctgggagtggggtcgaccaacgaataaagcaaagatggaaactggaccccgtaggttttacgnggactctgggtagaagggtccctttcacctatcctcagacgacaacaccaaagtaattcactagtactactaacaactagaaacacgcctaggggaagtaggtccgacacggaccgaccggtaccggtagttattaccgtggttcgcggaaggtagttagggtaaaggaaaaaaggtttagtcgggttagttggtttagttttaagggttgggggaaccgaggggtaccgttccccgttgggttccctaaccccgg

SEQ ID NO: 411288 - DNA, 731 bp, Homo sapiens
  misc_feature: GZ8MTXP01EKELP.17.28.C06.1.454.CMB.2.raw
  modified_base (239)..(239): a, c, t, g, unknown or other
  modified_base (264)..(264): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtcgtcgggacccccggaggaggtcaccatatcttgttctaggaaacncgctcgctactctactaactaactntttcgctacgacagactaactccgacggaccgtcccgacccctactcctacatactaataagtaatgactcgtaccgtcccggtccccgtccggggtccctacgtaccccgttacttcgtcgtcggtccctacctagttcgtcgtccgaccctacccgtccgtaccgtcccctacccgtacgtaccctagtaccggtacgggtccgggtacccggttacccgggtacgggaacgggtacgtacggacggttcttaacggtttaacttttaacggttcgggttacggtccggtaccggtaccggggtaggtacttacggaccttacgttaccggtaggttacgggttcggggttccgggttcgggttaccgggggacggggacggaaccggtcggttaccgttaccggttacccgttaaccgtaacgtcccgaccggacccggttacggtccccgttcccggtccccg

SEQ ID NO: 411289 - DNA, 630 bp, Homo sapiens
  misc_feature: GZ8MTXP01C9KAV.17.28.C06.1.454.CMB.2.raw
  modified_base (274)..(274): a, c, t, g, unknown or other
  modified_base (299)..(299): a, c, t, g, unknown or other
  modified_base (337)..(337): a, c, t, g, unknown or other
  modified_base (374)..(374): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtccagtgtgaggtccagttggttgaggtcggggagcctggtccagccgtgggggtccctgagctctcctgtgcagccctcgattcccctnagtagttatggatgacttgggtccnccagactccgaggggaggggctggagtgggtgaccaanagtaaagcaagagtaggactgaccccgtagtttacgnggactcgtgtgaacgggtcctttacaccatctcagacacaacgaccaagtaacttcacttagtacttacaaacaactagaaacacgacctagggaacgaggtaccgacgaacggacccgtaccgggtccgttagttacttaccgtgtcggacggaagtagttaggtaaaggttaaaaagttagtgggttacgttggtttaggtttaaggttcgggggaaccgtagggggacgttcccggttggttcccgtaacccg

SEQ ID NO: 411290 - DNA, 662 bp, Homo sapiens
  misc_feature: GZ8MTXP01DIGLC.17.28.C06.1.454.CMB.2.raw
  modified_base (205)..(205): a, c, t, g, unknown or other
  modified_base (234)..(234): a, c, t, g, unknown or other
  modified_base (240)..(240): a, c, t, g, unknown or other
  modified_base (255)..(255): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccacctcagtgtcgtcgggaccccggnagaggtcaccatatcttgtctaggaaacngctcgnatctacaactaactnttttgctggtacagcaacttcccgagactccccggcccccgtactcctacatctaataagaaatgtactcacgtccggtccccgttcccggggtccctggacccgtactttcctcgtcggacctcctaagttcgtccgtggccctaaccctcgaacccgtccctccctacgaacctagtcgacggtcgggtcccgttacccgggtaccggaaggtacgtccggagtctagtatttacgttacgtcgtcgaccgtacgggttggacttcgactacgttccgtaggtaacgtcgggttccgggtggttaccgggcgggtacgggaccgtagggtaccgttacggttacccggttacgtaaacggtccaaccggacccgaacgttcccgtccccggttaaccccgttcgg

SEQ ID NO: 411291 - DNA, 665 bp, Homo sapiens
  misc_feature: GZ8MTXP01BXK28.17.28.C06.1.454.CMB.2.raw
  modified_base (211)..(211): a, c, t, g, unknown or other
  modified_base (239)..(239): a, c, t, g, unknown or other
  modified_base (602)..(602): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcacgcccaccctcagtgtccgtcgggacccccggnagaggtcaccatatcttgtctagaaacngctcgcatctacaactaactattttgctgtaccagcaacttcccgagacgtcccggcccccgactcctcatctaataagaatgactcgacgtccggccccgtccggtccctgtaccccgtattcgcgtcgcctaccagttcgtcgtcggccaccgtccaccgtcccctcccgtacgacctacgtccgacgggttccgggcccgttaccccggggtccggaaggtagtcgggacggtacgtagtttaacgtttaacggttacgttgggtccgaccgtacccggttaggggacttacggactacgtaccgtaggtaacggttcgggttaacccgggttgggttccggggaccggttagggaccgngggttaccgccggttacccgttctaacggtccacggaccccgaggtcccgttcccgtccccgg

SEQ ID NO: 411292 - DNA, 734 bp, Homo sapiens
  misc_feature: GZ8MTXP01EBOAJ.17.28.C06.1.454.CMB.2.raw
  modified_base (206)..(206): a, c, t, g, unknown or other
  modified_base (236)..(236): a, c, t, g, unknown or other
  modified_base (244)..(244): a, c, t, g, unknown or other
  modified_base (259)..(259): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggaccccggnagaggtcaccatatcttgttctaggaaacngctccggnatctacaactaactntttgctggtaccagactaacttcccgaggacctccggccccccgtatccctacactctaataagaaactgactcacgtccggccccgttccgggggtccctgacccgtacttcctcgtcggcctccaattcgtctggcctaccgtcacgtcccctcctacgacctactacgtacgggtcgggtccctacccggggttaccggaacggttaacggtacggtacggttcgttaacggtttaaacttttacgttacggggttcgtacggtaccgtaacgggttaggtacgttacgtaacgttaccgtacgttaacggttaacgggttccggggttccggggttaacggggttccggggttaaccggggtaaccggggttacccgtacgggtacccgttaccgggttacccggttaccgttaaccggtacccgtaaccggacccggtaccggttccccgtccccggttccccgtaaccg

SEQ ID NO: 411293 - DNA, 643 bp, Homo sapiens
  misc_feature: GZ8MTXP01B2IY3.17.28.C06.1.454.CMB.2.raw
  modified_base (279)..(279): a, c, t, g, unknown or other
  modified_base (405)..(405): a, c, t, g, unknown or other
  modified_base (623)..(623): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgttgctgttttagaaggtgtccagtgtgaggtccagttggttgaggtccggggagcctggtccagccgtgggggtccctgagactctcctgtgcagcctccggacttccccttnagtagttatggatgtacgttgggtccgcacgactccgaggggaaggggctggggaggtggggtacggaccaaacaagtaaaagcaaaggatagggaaactggtacccccggtaaggtttttacggnggtaacctcttagggtagggtaacggggtcccgttttacaccctattcctacgaagaacgacaacgaccaaagaacttcattagtatactacaactacgaacagccgtaggagtacgcgacacgacgaccgggtcgttagtatttacgtgtgcgaagattagggtaaaggaaaagttagtggagttggttagtttaaggtcgggggccgagggggacncccgttggttccgtaacccg

SEQ ID NO: 411294 - DNA, 652 bp, Homo sapiens
  misc_feature: GZ8MTXP01BI92N.17.28.C06.1.454.CMB.2.raw
  modified_base (386)..(386): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaacttgggttttccttgttgcttgttttagaaggtgtcagtgtgaggtcagttggttgagtccggggagctggtcagccgtgggggtcctgagactctctgtgcagcctccggtacttccccttcagtagttattggatgacgtttgggtccgccagacgtccgaggggaagggcgtggaggtggggtggaccaaacaagtaaagcaaagagtaggaactggaccgtacgttttacggnggtactcgtggtacggaacgggtcccgtttacaaccctattcctaccgaaggacgaaaccgaacgacctaaagtaacttcaacttgttaactactaaacaacgtagaaacctaggcctaggaacgggacgtccgacacggaccgaccgggtccgttagttacttacgtgtgacgagaagttaggttaaagtaaaagttacgtggtacttggttggttttaggcggggtcgaacggggtcgtcccgttggtcccgttaaccgtcccg

SEQ ID NO: 411295 - DNA, 630 bp, Homo sapiens
  misc_feature: GZ8MTXP01EBOGZ.17.28.C06.1.454.CMB.2.raw
  modified_base (208)..(208): a, c, t, g, unknown or other
  modified_base (238)..(238): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccacctcagtgtcgtcggggaccccggnaggaggtcaccatatcttgtctaggaaacngctccggcatctacaaactaactattttgctggtaccagactaacttcccgaggtacctcccggcccccctactccctacatactaataagtaaatgaactcacgtccggccccgtccggggtccctcgaccccgtattctcgtcgcctacattcgtctcggtccctacctcgaccgtcccttaccctacgacctactcggacggtcgggtcccgtcccgggtcggaaggtcgtacggacggtctagttaatttacgttacgtggtcgtacgtaaccggtggtactcgtaactacgtccgtagtacgtgggtccggttggttcgggcggacggtcgaggccgttcggaccgtaactaagtcgaacgtcccgaacggtccgttcccgtccccg

SEQ ID NO: 411296 - DNA, 634 bp, Homo sapiens
  misc_feature: GZ8MTXP01DNZVD.17.28.C06.1.454.CMB.2.raw
  modified_base (269)..(269): a, c, t, g, unknown or other
  modified_base (294)..(294): a, c, t, g, unknown or other
  modified_base (366)..(366): a, c, t, g, unknown or other
  modified_base (371)..(371): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaacttgggttttccttgttgcttgttttagaaggtgtcagtgtgagtcagttggtgaggtcggggagctggtcagccgtgggggtcctgagctctctgtgcagcctccggtacttccccttnagttagttatggatgacttgggccncagctcgaggggaagggctggagtgggtacgaccaaacagtaaagcaagatggaactgccgtagttttacgngactntggtaggaacgggtccgttacacctatcctccgaagacgaaccaacgacaaagtaacttcaacttagtaatactaacaactagaacacgtacctaggaaggacgtcgacaacggaccgacgggtccgttagttaactttacgtggtagcggtaagaagttaagggttaaaggtaaaaaagttagtacggtgttagggtttggtttaggttcgggggacccgtaaggggtaccgtcccggttacggtcccgttaaccggttccc

SEQ ID NO: 411297 - DNA, 696 bp, Homo sapiens
  misc_feature: GZ8MTXP01CJFH8.17.28.C06.1.454.CMB.2.raw
  modified_base (275)..(275): a, c, t, g, unknown or other
  modified_base (299)..(299): a, c, t, g, unknown or other
  modified_base (378)..(378): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagcctggtccagcgtgggggtccctgagactctcctgtgcagcctccggattcccctnagtattatggatgacttgggtccncagactccgagggaaggggctggaggtgggtaggaccaaacataaaagcaaagataggaactgccccgtagttttacgnggtactcgtaggtgaacggggtcctttcaaccgtatcctaccagaacgaccaaacggacccaaaaggtaactttaccaacgttacgttaactacccttaaaccgaaaccttacggaaaaccacgggtacccttaggggaacggtaacggtccgacgaacgaaccgtacgggccgtttaagtacgttaacgtggttacgcggaaagtaagttagggttaaaagggaaaaaaagttaagtgggttcgttgggtttaggttttaaggtagggggtcccgaagggggtaccgttcccgttaacggggttccttaaccccggg

SEQ ID NO: 411298 - DNA, 612 bp, Homo sapiens
  misc_feature: GZ8MTXP01D4QK6.17.28.C06.1.454.CMB.2.raw
  modified_base (279)..(279): a, c, t, g, unknown or other
  modified_base (392)..(392): a, c, t, g, unknown or other
  modified_base (531)..(531): a, c, t, g, unknown or other
tcagcgtagactagcacgaccggtgctcgatttagagctcacgtattggggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggttgaggtccggggagcctggtccagccgtgggggtccctgagactctcctgtgcagccctcggacttcccctnagtagttatggatgacgttgggtcccgaccagactccgaagggaacggggtctagggagtcgggtggaccaaagaataaaagcaaagatgggaaactgcccgtagttttacgnggactcgtagtagaacgggtcctttacaacctattcaccgaagacaacaaacgacctaaaagaatactactatatactaacaacacgaacacgacgtaggagagacgacgacgacgacgtacgtagtattagtagtagngaagtaagttagtaaagttaaaagtaaagtagttagttgttagttaaggtggtaacggacggacgccgtcgttcgtaaccg

SEQ ID NO: 411299 - DNA, 654 bp, Homo sapiens
  misc_feature: GZ8MTXP01AFVRS.17.28.C06.1.454.CMB.2.raw
  modified_base (389)..(389): a, c, t, g, unknown or other
  modified_base (553)..(553): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggagcctggtccagccgtgggggtccctgagactctcctgtgcagccctccggtacttccccttcagttattatggatgacgttgggtccgccagactccggaggggaggggctgggagtgggtgaccaacataaagcaagataggaaactcggaccccgttagttttacgnggtactcgtagtagggaacgggtccctttacgacctactccgtaccgagaaacgactaaaccgaccaaagtaacttacacgtagtactactaaacaacgttacgaaaccacggccctaggggacgtacgtacgacaaggaccgaccggtccgtagtacttacgngtcgagaagtagttaggtaaaggaaaacgttgtaggttgttggttggtttaagggtcgggtaacggacgggtacgttcccgttaaggttcccgtaaccccg

SEQ ID NO: 411300 - DNA, 639 bp, Homo sapiens
  misc_feature: GZ8MTXP01EQ5BW.17.28.C06.1.454.CMB.2.raw
  modified_base (189)..(189): a, c, t, g, unknown or other
  modified_base (211)..(211): a, c, t, g, unknown or other
  modified_base (241)..(241): a, c, t, g, unknown or other
  modified_base (247)..(247): a, c, t, g, unknown or other
  modified_base (261)..(261): a, c, t, g, unknown or other
  modified_base (583)..(583): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcgagggtcctgggcccagtctgtgctgactcacgcccaccctnagtcgtcgtcggggaccccggnagacggtcaccatatcttgttcaggaaacngctcgnatctacaataactntttgctgacagctaactccgagctcccggccccactcctacatactaataagaaatcgataccacgtcccggcccgttcccgggtcctacgaccgtacttctcgtcgcctcctaagttcgtcgtcggccctacccgtcaccgtccctccgtacgacctaagtcgtacgggtcgggtccgtacccgggtacgagggtacgttggaacggtcttaggtaactttaacgttacggtcggttacgaccgtaacgggtggtactacgtactaacgttcgtacgggtaacgttcggggttaccggtggtccgggacgggtacggacgnggtccgttacggttccgttacgtaagccgaacgtaccgcgcctcccgttcccgtcg

SEQ ID NO: 411301 - DNA, 586 bp, Homo sapiens
  misc_feature: GZ8MTXP01APAU9.17.28.C06.1.454.CMB.2.raw
  modified_base (490)..(490): a, c, t, g, unknown or other
  modified_base (496)..(496): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccggcaggagggtcaccatatcttgttctaggaaacagctccggcatctacaaactaaactattttgctggtaccagacaacttcccaggactcccggccccccgactcctcatctaataagaaatgatcacgtccggccccgtccggggtccctcgaccccgtacttctcgtcggctacccattcgtctcggcctacctcacgccctccctgaccctatcgaggtcgggccttcccgggtcgagtagtcggaggctagtatttacgttactgtcgcacggtggacngtaacngtcctagacgttcgggtcggtggttcgggcggacggaccgacggcgttcgaccgttcgtaagtcgacgcccgaggcccgttcgtcccccg

SEQ ID NO: 411302 - DNA, 627 bp, Homo sapiens
  misc_feature: GZ8MTXP01DFU7F.17.28.C06.1.454.CMB.2.raw
  modified_base (383)..(383): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgagtccagttggtgagtccggggagctggtccagcgtgggggtccctgagactctcctgtgcagccctccggacttccccttcagtagttatggatgacgttgggtccgccagactccgaggggaggggctgggaggtggggtggaccaacaataaagcaaagataggaactggccccgtagttttacgnggtactcgtagtgaacggggtcccgtttacacctatcctccgagacaacaacgaccaaagaacttcactagtactactaacaactagaacagcctagggaagagtccgacgaggaaccgcggtccgttagtacttacgtggtgcgaagtagttagggtaaaggaaaagttagtggttacgtttggttaggttttaaggtcgggggccgaggggtcgttacccgttcgggttaacctaaccccgg

SEQ ID NO: 411303 - DNA, 641 bp, Homo sapiens
  misc_feature: GZ8MTXP01BKPLN.17.28.C06.1.454.CMB.2.raw
  modified_base (279)..(279): a, c, t, g, unknown or other
  modified_base (306)..(306): a, c, t, g, unknown or other
  modified_base (392)..(392): a, c, t, g, unknown or other
  modified_base (620)..(620): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggttgagtccggggagcctggtccagccgtgggggtccctgagactctcctgtgcagccctccggattcccccttnagtagttatggatgtacgttgggtccncagacgtccgaggggaaggggctgggaggtgggtcggaccaaacataaaagcgaaagagtaggaactgaccccgttagttttacgnggactcgtagtagaaggggtccctttcaccgtatccgtccgagacgaaccaacgacctaaaagtattaccgattacgttatacctaacaaactgaaaccagccgtagggacgtagtccgacgaacgaccgacgggtccttagttacttacgtggtcgagaagtagttagggtaaaaggaaaagtagtggttgtttggttacgtttaagggttcggggcgtacggggcncccggttggttaaccgtcccg

SEQ ID NO: 411304 - DNA, 619 bp, Homo sapiens
  misc_feature: GZ8MTXP01BME79.17.28.C06.1.454.CMB.2.raw
  modified_base (278)..(278): a, c, t, g, unknown or other
  modified_base (344)..(344): a, c, t, g, unknown or other
  modified_base (382)..(382): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagccgtgggggtccctgagactctcctgtgcagcctccggattcccctnagtagttatggatgacttgggtccgccagactccgaaggggaaggggctggagtggggtgccaaanataaaagcaaagatggaaactgccccgtagttttacgnggactctagtagaaggccccgtttacacccatcctccaagaacgaacaaacgaccaaagaattcaactgtaatactaacaaactagaaacagcctagggaagagtcgacaagaccacggcctagtattactgtgcgaagattaggtaaggaaaaaagttaatcgggttacttggttaggttttaacggttcgggggaacccaagggggacgttccccgttggggttccctaaccccg

SEQ ID NO: 411305 - DNA, 762 bp, Homo sapiens
  misc_feature: GZ8MTXP01BDLGU.17.28.C06.1.454.CMB.2.raw
  modified_base (179)..(179): a, c, t, g, unknown or other
  modified_base (214)..(214): a, c, t, g, unknown or other
  modified_base (229)..(229): a, c, t, g, unknown or other
  modified_base (260)..(260): a, c, t, g, unknown or other
  modified_base (284)..(284): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggtttctgttgctgtttagaggtntcagtgtgagtcagttgtgagtcgggagctgtccngcgtggggtcctganactctctgtgcagcctccggacttccccttnagtattatgatgtactcgggtccncagactcgagggagggctggagtgggtgaccaagaagtaaagcgaagtagacggtaactcggtaccccgttaggttttacggcggtaacttccgtaagggtacgggtaacggggtcccttttaccgaacctacttccgaccgaaggaaccgaacctaaaccggacctaaagtaccttcacgttactactacgtaaccaacttacgaaactcgacccgtaggggacgtaacggtcccgaacgtaaggaaaccccgttccggggtacccgtttaaggttaccgttttaacgggtacgggttaccggaacggggtaaacggttaaggttaaacggggttaaaaacgggttaaaaacggttaccggggttgggtttacgggttttaacgggtttaccggggtttaacgggggttcccgggggtaacccggtaacgggggttccccgttcccggggttaaccgggttcccccgttaacccggg

SEQ ID NO: 411306 - DNA, 754 bp, Homo sapiens
  misc_feature: GZ8MTXP01D491B.17.28.C06.1.454.CMB.2.raw
  modified_base (209)..(209): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagcccaccctcagtgtcgtcggggacccccggnagagggtcaccatatcttgttctaggaaacagctccggcatctacaaactaaactatttttgctaggtaccagacctaacttcccgaggactccccggaccccccgtactcctacactactaactaagaaaatgactccgaacgtcccgggccccgttcccgggggtccctaggacccgtacttcctcgtcggtcctcccgtaattcgttccgtgggtaccctaccctccgaaccggtccccttaccccgtacgtaacccctaagttcccgtaacggggtccgggggtccccgttaccccggggttacccggaaagggtacgttgggaaacgggtccttaaggtaattttaacgtttaacgggttcggtacggtacccggtaaccgggtttggggacttacggaacctaacgttccgtaaggtaacgtttcggggttccggggttcggttcgggggacgggtaacgggaccgtacgggtccttacggttacccgttaccgtaaggtccaacgtccccggagttcccgtcccgttcccccgttcgg

SEQ ID NO: 411307 - DNA, 626 bp, Homo sapiens
  misc_feature: GZ8MTXP01B5LXH.17.28.C06.1.454.CMB.2.raw
  modified_base (214)..(214): a, c, t, g, unknown or other
  modified_base (221)..(221): a, c, t, g, unknown or other
  modified_base (247)..(247): a, c, t, g, unknown or other
  modified_base (266)..(266): a, c, t, g, unknown or other
  modified_base (390)..(390): a, c, t, g, unknown or other
  modified_base (430)..(430): a, c, t, g, unknown or other
  modified_base (494)..(494): a, c, t, g, unknown or other
  modified_base (514)..(514): a, c, t, g, unknown or other
  modified_base (544)..(544): a, c, t, g, unknown or other
  modified_base (571)..(571): a, c, t, g, unknown or other
  modified_base (576)..(576): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttggttttccttgttgcttgttttagaggtgtcagtgtgagtcagttggtgaggtcgggngctgtcngcgtggggtcctgagctctctgtgcncgcctccgacttccccttnagttagttatggatgtacgttcgggtccgcagactccggaaggggaggggtctgggaggtggggtcggaccaaacaagtaaaaggcaaagagtaggaaactcggaccccgttaggttttacggnggtacctcgtaggtggaacggggttccctttacgaacctnttccaccagaaacaacgaacccgacaaagtacttacacttagtactacttaacaactagaaacngtacctagggaagtcgtacncgacgaccgacggtctagttatcgtgtcgngtaagattagggaaacgaaaagttagnggttnttggttgtttaaggcgggggaacacgggggcttccggtggttaacctccg

SEQ ID NO: 411308 - DNA, 612 bp, Homo sapiens
  misc_feature: GZ8MTXP01B67TU.17.28.C06.1.454.CMB.2.raw
  modified_base (271)..(271): a, c, t, g, unknown or other
  modified_base (297)..(297): a, c, t, g, unknown or other
  modified_base (328)..(328): a, c, t, g, unknown or other
  modified_base (375)..(375): a, c, t, g, unknown or other
  modified_base (518)..(518): a, c, t, g, unknown or other
  modified_base (592)..(592): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtcagtgtgaggtcagttggttgaggtcggggagctggtccagccgtgggggtcctgagactctctgtgcagcctcggattcccctnagtagttatggatgacgttgggtccncagactccgaagggaggggctgggagtgggngaccaaacaataaagcaaagataggaactgaccccgtagttttacgnggactctagtagaacgggtccgtttcaaccatctaccagaacacaaacgaccaaagaacttcaacttagtatactaacaaactgaaacagcctaggggaaagtcgtcgacaagacgacgggccgttagttaacttatggtcgngtaagagttaggtaaacggaaaaaaggttatcgggttgttggttagttttaacggtggggaacctaagggggcncccgtaagttccgtaacccg

SEQ ID NO: 411309 - DNA, 722 bp, Homo sapiens
  misc_feature: GZ8MTXP01A8ZNN.17.28.C06.1.454.CMB.2.raw
  modified_base (275)..(275): a, c, t, g, unknown or other
  modified_base (403)..(403): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtcagtgtgaggtcagttggttgaggtcggggaggctggtcagcgtgggggtccctgagactctcctgtgcacgcctccggacttccccttnagtagttatggatgtacgttgggtcccgccagacctccggaaggggaaggggcgtgggaggtggggtacggaccaaacgaagtaaagcgaaagagtaggaacgtcggaccccggttaggttttacggnggtacttcgtaggtggtaacgggtccgtttaccaacctatcctacgagacgaccaacgacaaagtacttcaacttagtaactactaacaacgtacgaaactacgcccgtagggaacggtacgtaccggaccgtaacggaacccgtcggggtacccgtttaggttactttaccgggtgttacgggcggaaggtaaggttagggtaaaagggttaaaaacgttaggttacggttcggtttaggtttacggggttttaaggttacggggggaaccgttaacgggggccttaccccggttcgggttaacccgttaacccccgg

SEQ ID NO: 411310 - DNA, 674 bp, Homo sapiens
  misc_feature: GZ8MTXP01AIH54.17.28.C06.1.454.CMB.2.raw
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggcaggagggtcaccatatcttgttctggaaacagctccggcatctacaaactaaactatttttgctggtaccagcaattcccaggactccggccccccgactccctcatctaatagaatgatcactccggccccgtccgggggtccctcgaccgtacttcctcgtcggtcctccaattcgtccgtcgggacctacctcgacgtccctccctacgaccctatccgtaggtcgggccgttcccgggtaccgaggtacgttcggaacgggtccttggtaattttacgttaaccggttggtcgtaccgtaccgggtgggtacgtcggactacgttccgttaagtaacgttcggggtcccgggttcgggtaccggggttcggggaacgggaccgtacgggtccgttacgggttcccgttaccgtaaacggtcgaaccggcccctaacggggcctaacccggccccgttaaccgg

SEQ ID NO: 411311 - DNA, 836 bp, Homo sapiens
  misc_feature: GZ8MTXP01BOUUG.17.28.C06.1.454.CMB.2.raw
  modified_base (187)..(187): a, c, t, g, unknown or other
  modified_base (208)..(208): a, c, t, g, unknown or other
  modified_base (234)..(234): a, c, t, g, unknown or other
  modified_base (256)..(256): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccacctnagtgtcgtcgggacccccggnagaggtcacatatcttgtcagaaacngctcgcatctacaactaaactntttgctaggtaccagtacctaaacgttcccgaaggtaccgtccccgggaccccccctaacttccctactaattacctaaagtaaacggtaaaatcggtaacttaccgtaaccggttcccccgggtaccccccgttcccggggggttacccctacggtaaaccccccggttacttttccgtcggttacccggtacccttccccgtaagtttccggtacccgttaccgggccccctaaaccccttccggaacccgtccccctttaccccggtacgaaacccctgttacccgaacggggttccgggtcccgtttacccccgggggtacgaagggtaacgttcgggaaagggttccttagtttaaactttaacggttaagtcgggttaccggacccgtttaaccgggggtaggtaacgtaccgtaaaccgttcgttaccgggtaggttaacgggttcccgggggttaacggttcggggttaccggggaacgggttaccgggacgtcggttacccgttaccggttacccgttaaccgtacggtcccgaaccgggacccgttaccggtcccgttccccggtccccg

SEQ ID NO: 411312 - DNA, 623 bp, Homo sapiens
  misc_feature: GZ8MTXP01CX4OT.17.28.C06.1.454.CMB.2.raw
  modified_base (391)..(391): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagtggttgagtcggggagcctggtccagcgtgggggtccctgagactctcctgtgcagcctccggacttccccttcagtagttatggatgacttgggtcccgcagactccgaggggaggggtctgggaggtggggtacggaccaaagaataaaggacaaggataggaactggtacccgtaggttttacggnggtactcgtaggttgaacggggtcctttcaccgtatctacagacacaacgaccaaagtatcatgtatactacaactagaacagcctagggacgagtcgacgaacgaccgcgggtaccgttaggtacttaccgtggtcgcggtaagtagttagggtaaaggttaaaacgtaagtggttagttggttaggtttaaggtcggggcaaggggtcgacccgttggttcccgtaaccg

SEQ ID NO: 411313 - DNA, 639 bp, Homo sapiens
  misc_feature: GZ8MTXP01C2FRE.17.28.C06.1.454.CMB.2.raw
  modified_base (271)..(271): a, c, t, g, unknown or other
  modified_base (367)..(367): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcttgttgctgttttagaaggtgtccagtgtgaggtcagttggtgagtcggggagctgtccagcgtgggggtcctgagctctcctgtgcacgcctccggacttccccttnagtagttatggatgtacttggtccgcagactcgagggaggggctggaggtggtgaccaacataaagcaagataggaactgacccgtaggtttacgnggactcgtagtagaacggggtccctttacacctatcctacaagacgaaccaacgacccgaaagtaacttacaactagttaactacctaacaaactagaaactacgacccttaggggaacgtacggtaccgaccgaaagacccgacgggtccgttagtaacttacgtgtacgcggtaagtaagttaggtaaaggaaaaagttaagtggttacgttggtttaggtttaaggttcggggaacgtacggggacgttcccgttggttccgtaacccg

SEQ ID NO: 411314 - DNA, 700 bp, Homo sapiens
  misc_feature: GZ8MTXP01AKTW6.17.28.C06.1.454.CMB.2.raw
  modified_base (209)..(209): a, c, t, g, unknown or other
  modified_base (249)..(249): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcacgccaccctcagtgtcgtcggggaccccggnaggacggtcaccatatcttgttctaggaaacagctccggntatctacaactaactatttgctggtacagctaacttccgaggctcccggcccccatcctcactctatagaatgatcacgtccggtaccccgtccggggtccctacggaccccgttacttcgtcgtcggccctacccgtagttcggtctacgggcctaacccgtcaccggtccccttcccgtacgacctacgttccgacgggttccggggaccgtacccggggtacggaaaggtcgtacgggtcggtacttaagttacgtttaacggttacgtgggttacgacccggtaaccgggttgggacttacggaacgtacgttccggtaggtaacggttcggggttccgggttgggttcccgggacggggacggtacccgtacgggttccgttcggttaccccgttaacgtaacggtcccgaaccggtaccccgacggttcccgcccggttcccccg

SEQ ID NO: 411315 - DNA, 557 bp, Homo sapiens
  misc_feature: GZ8MTXP01B0QQH.17.28.C06.1.454.CMB.2.raw
  modified_base (205)..(205): a, c, t, g, unknown or other
  modified_base (304)..(304): a, c, t, g, unknown or other
  modified_base (356)..(356): a, c, t, g, unknown or other
  modified_base (474)..(474): a, c, t, g, unknown or other
  modified_base (512)..(512): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctaaccctcctcactcactgtgcagggtcctgggcccagtctgtgctgactcagccaccctcagtgtctgggacccccggnagagggtcaccatatcttgttctggaaacagctccggcatctacaaactaaactattttgctggtaccagcaattcccaggactccgccccccgatccncatctatagaaatgatcatccggcccgtccggggtccctgaccgatttcccnctggcctcccatcgtctggccacctcacgccctccctgacccatcgaggtcgggctaccggtcgacggatgagggcttagaatttagttaccgtggtcgactccggtagggactgacntccgtgtacgtggtccggtgtaacgggcggaggaccgnggctcgaccgttcagtcacgccgacgccttccgtccccgttcgtc

SEQ ID NO: 411316 - DNA, 721 bp, Homo sapiens
  misc_feature: GZ8MTXP01CZ4RT.17.28.C06.1.454.CMB.2.raw
  modified_base (279)..(279): a, c, t, g, unknown or other
  modified_base (334)..(334): a, c, t, g, unknown or other
  modified_base (382)..(382): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgaggtcgggggagcctggtccagccgtgggggtccctgagactctcctgtgcagcctccggacttccccttnagtagttatggatgacgttggtccgcagactcgaggggaggggctgggagtgggngccaacagtaaagcaagataggaactcggtaccccgtagttttacggnggtaaccttcgtagggttacggaacggggttcccgttttacccaacctactccgtaccgaaggacgaaccaacggaacccaaagtaacttacctaacgtagttactactaacaaacgtacgaaacacgccgtaggggaacggacgttcgacgaacgaaccgtaccgggtaccgttagtaacgtttacggtgttacggaccggtaaaggaagtttaggggtaaaaggaaaaaaggtttaaccgtggggtttacgtttgggtttacggttttttaagggaccggggggtccggtaaggggggtaccgttaccccggttcggggttaacccttaaccccggg

SEQ ID NO: 411317 - DNA, 685 bp, Homo sapiens
  misc_feature: GZ8MTXP01CKMEM.17.28.C06.1.454.CMB.2.raw
  modified_base (271)..(271): a, c, t, g, unknown or other
  modified_base (669)..(669): a, c, t, g, unknown or other
  modified_base (672)..(672): a, c, t, g, unknown or other
  modified_base (675)..(675): a, c, t, g, unknown or other
  modified_base (677)..(677): a, c, t, g, unknown or other
  modified_base (679)..(679): a, c, t, g, unknown or other
  modified_base (682)..(682): a, c, t, g, unknown or other
  modified_base (684)..(684): a, c, t, g, unknown or other
tcagcgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaactatttttgctggtaccagcaattcccaggactccggccccccgactcctcatctaatagaaatgatcatccggccctccggggtcctgaccgnttctctggctccatgtctggcacctcacgcctccctgaccatcgagtcgggctccggtccgaggatgaggctagtactttagttacgtggtcgcgaccggtggggatacgacaacgtccgtagaacgttcgggtccgggtcggtttcgggcgggtacggggaccgacgggtccgtacggtacccggtaccgttaaaacgttccgaacggaccccgaaacgggtcccgtacccggccccccgttcgggttaccctacccgtttcccgttcccggtttccccccggtcccctttccccttacccgttaaccgttcccgttaccggtccgttacgggaaccggtccgggggtcccgttggggacccggtaaacgggcccgtaccgtaagttaccggcgcgngcncgncncncgngng

SEQ ID NO: 411318 - DNA, 657 bp, Homo sapiens
  misc_feature: GZ8MTXP01DHOHX.17.28.C06.1.454.CMB.2.raw
  modified_base (238)..(238): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccggcaggagggtcaccatatcttgttctgaaacngctccggcatctacaactaaactatttttgctggtacagctaacttcccaggactccggccccccactcctcatcctaatagaaatgactcacgtccggcccctccggggtcctgacccccgtattctcgtcggcctacccattcgtctcgggccctaccgtccacgtcccctccctagaccctactcgacgggtcgggccgttacccgggtacgaggtaacgtggaacggtcttagtaactttagttacctggtccgaccgtaaccggtgggtactcgaactcgttccgtaggtaaacggtttcggggttcccggtgggtttccggggaccggggaacggaccgtaacggttccgttccggttaacccgtccgtaaacgtccaaccggcccgaacggtcccgttccccggtcccccgg

SEQ ID NO: 411319 - DNA, 661 bp, Homo sapiens
  misc_feature: GZ8MTXP01ANVY6.17.28.C06.1.454.CMB.2.raw
  modified_base (217)..(217): a, c, t, g, unknown or other
  modified_base (273)..(273): a, c, t, g, unknown or other
  modified_base (298)..(298): a, c, t, g, unknown or other
  modified_base (326)..(326): a, c, t, g, unknown or other
  modified_base (333)..(333): a, c, t, g, unknown or other
  modified_base (372)..(372): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgttttagaaggtgtccagtgtgagtcagttggtgagtcggggngctggtccagccgtgggggtcctgagactctctgtgcagcctccgtattccccttnagtagttatgatgacgttgggtccncagactcgagggagggctgggagtgggngaccaanataaagcaagataggaaactgaccccgtagttttacggnggtactcggtagtacgggaacgggttccctttacgacctacttccgtaccaagaacgaaccaaaccggaccaaagtaacttcaactagtaactacctaacaaacttagaacacgtccgtagggaagacgtcgacaggaccgtcggccgttagtaacttaccgtggtagtcggaagtaagttaggtaaagggaaaaaagttaggtgggttacgttggtttaggttttaacgggttcgggggaacccgggtaggggtaccgttccccggttgggttaacccctaaccccgg

SEQ ID NO: 411320 - DNA, 733 bp, Homo sapiens
  misc_feature: GZ8MTXP01A0EZT.17.28.C06.1.454.CMB.2.raw
  modified_base (239)..(239): a, c, t, g, unknown or other
  modified_base (273)..(273): a, c, t, g, unknown or other
  modified_base (393)..(393): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgttttagaaggtgtccagtgtgagtcagttggtgaggtcggggagctgtccagcgtgggggtccngagctctctgtgcagccctccggacttccccttnagttagttatggatgtacgttgggtccgcagactccgaggggaaggggctgggaggtggggtacgaccaaacagtaaagcgaaagagtaggaaactggtacccccggttagttttacggnggtactcgtaggtacgggtaacgggtccgtttaccacctactccgtaccgaaagaacgaacccaaaccggaccctaaaaggtaacttaccgaacgtttacgtaaactttacccttaaacaaaccgttaacgaaaccgtacgtaccccgttaagggggaacggtaacggttcccgacgaaacggaaccgtaaccggggtccgtttaaggttaactttacgtggttacggacgtaagtaagttaagggtaaaggttaaaaagttgtaggttcgttggtttagggtttaaggtcgggggaaccgtaaggggtccgttcccggttcggttcccgttaaccccgg

SEQ ID NO: 411321 - DNA, 561 bp, Homo sapiens
  misc_feature: GZ8MTXP01ALNXI.17.28.C06.1.454.CMB.2.raw
  modified_base (273)..(273): a, c, t, g, unknown or other
  modified_base (370)..(370): a, c, t, g, unknown or other
  modified_base (489)..(489): a, c, t, g, unknown or other
  modified_base (514)..(514): a, c, t, g, unknown or other
  modified_base (555)..(555): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcaaagaggactcaccatggagttggggctgaactgggttttccttgttgctgttttagaaggtgtccagtgtgaggtcagttggtgagtcggggagcctggtcagcctgggggtccctgagactctcctgtgcagcctccggattccccttnagttagttattggatgacttgggtccgccagactccgagggaaggggctggagtgggtgccaacataaagcaagatggaactgccgtagttttacgnggactctgtagaacgggtccgtttacaccatctccagacgacaacgacaaagattacactgtatctacaactgaacagcctgaggagtcgcacgacacgccgtgtaacttactgtgcgngaataggttaggaaaaattagtggnttgttgtttagtgggggcctggggacgcccgttagggtccncgttcc

SEQ ID NO: 411322 - DNA, 723 bp, Homo sapiens
  misc_feature: GZ8MTXP01E3EZ0.17.28.C06.1.454.CMB.2.raw
  modified_base (208)..(208): a, c, t, g, unknown or other
  modified_base (237)..(237): a, c, t, g, unknown or other
  modified_base (245)..(245): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctaaccctcctcactcactgtgcagggtcctgggcccagtctgtgctgactcagcccaccctcagtcgtctcgggacccccggnagaggtcaccatatcttgtctaggaaacngctccggnatctacaaactaaactattttgctaggtacagactaacttcccgaaggaccgtcccggacccccccgtactccctcatactaataagaaaatgaactctacgtcccgggtcccccgttcccgggggttccctacgtaccgtactttccctcgtggtccctcagttcgtccgttggccctaacccgtccaccggtcccctccccgttacgaacccagttccgaacgggttccggggtcccgttacccggggtacccggtaaggggaacttgggaacggtcctagttaaatttagttaacgtggggttacgaccgtaaccgggttgggaattacggacttacgtccgtaaggtacgttcgggtccgggttgggttccgggacggggaacgggtacccggaggtcctaccgggttacccgttacgttaccgtcgaaacccgtcccgaaggtccccgttccggtcccccgttcggttccccg

SEQ ID NO: 411323 - DNA, 571 bp, Homo sapiens
  misc_feature: GZ8MTXP01B1S9A.17.28.C06.1.454.CMB.2.raw
  modified_base (208)..(208): a, c, t, g, unknown or other
  modified_base (239)..(239): a, c, t, g, unknown or other
  modified_base (246)..(246): a, c, t, g, unknown or other
  modified_base (349)..(349): a, c, t, g, unknown or other
  modified_base (364)..(364): a, c, t, g, unknown or other
  modified_base (431)..(431): a, c, t, g, unknown or other
  modified_base (450)..(450): a, c, t, g, unknown or other
  modified_base (454)..(454): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccggnaggagggtcaccatatcttgttctggaaacngctcggnatctacaactaactattttgctggtaccagcaacttcccgaggactcccggcccccactcctcatcatagaaactgatcacgtccggcccgtccggggtcccncgtaccccgacttcncgtcgcttccattcgtctcgcaccctcgacgccctacctcgaccatcgagtcggctccggtcgaagngtcgagctgtacttgtacngtcncgacgtggactgaactctcctagtacttcggggtaaccgtggttccggggacgacggggtacacgggttcttcggcccgtaacgtaacgcaacggcccaacgggtccttccgccccg

SEQ ID NO: 411324 - DNA, 652 bp, Homo sapiens
  misc_feature: GZ8MTXP01E46IA.17.28.C06.1.454.CMB.2.raw
  modified_base (209)..(209): a, c, t, g, unknown or other
  modified_base (238)..(238): a, c, t, g, unknown or other
  modified_base (246)..(246): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctccaccctcctcactcactgtgcagggtcctgggcccagtctgtgctgactcacgcccacctcagtgtcgtcgggaccccggnaggaggtcacatatcttgttcaggaaacngctccggnatctacaactaaactattttgctggtaaccagactaacttcccgaggacctccccggaccccccactccctactatactataagtaaactgaactcacgtcccggtccccgtccgggggtccctggacccccgtattctcgtcggcctcccagttcgtctcgggcctacccgtcgacgtcccctccctacgacctatcgaggtcggccgtccgggtccggagatggacgctagtactttattacgtggtcgaccgtaccgggtggtacgtcggtaacacgtccgtaggaaacggttcgggttaaccgggttcgggttcggggaccgggaacgggtacccgagggttccttcggttacccgtaacgtacgtaacgacgacccgacgggtcccttaacccggtccccg

SEQ ID NO: 411325 - DNA, 642 bp, Homo sapiens
  misc_feature: GZ8MTXP01EAEDS.17.28.C06.1.454.CMB.2.raw
  modified_base (214)..(214): a, c, t, g, unknown or other
  modified_base (273)..(273): a, c, t, g, unknown or other
  modified_base (385)..(385): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgtttagaggtgtccagtgtgaggtcagttggtgagtccggggngcctggtccagccgtgggggtccctgagactctcctgtgcagcctccggacttcccctnagtagttatggatgacttgggtccgccagacctccgaaggggaaggggctgggaggtggggtggacccaaacgaataaaagcaaagataggaactgccccgtagttttacgnggactcgtaggtgaacggggtcctttacaccatcctaccgagacgacaacgaccaagaacttcacttgtatactaacaactcgaaacacgccgtaggacgtagtccgacaaggaccgacgggtccgttagttacgttacgtggtcggcgaagtagttagggtaaagggttaaaaagttacgtagggttcgttggttaggttttaacggttgggggaaccgtagggggacgttccccggtgggttcccgtaaccccgg

SEQ ID NO: 411326 - DNA, 579 bp, Homo sapiens
  misc_feature: GZ8MTXP01C6YJ5.17.28.C06.1.454.CMB.2.raw
  modified_base (275)..(275): a, c, t, g, unknown or other
  modified_base (378)..(378): a, c, t, g, unknown or other
  modified_base (501)..(501): a, c, t, g, unknown or other
  modified_base (505)..(505): a, c, t, g, unknown or other
  modified_base (509)..(509): a, c, t, g, unknown or other
  modified_base (532)..(532): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgagtcagttggttgagtcggggagcctggtccagccgtgggggtccctgagactctcctgtgcagcctccggattccccttnagtagttatggatgacttgggtccgccagactccgaggggaaggggctgggaggtgggtgccaaacataaagcaagatggaactgaccccgtaggttttacgnggactcgtagtagaacgggtccgtttcaccatcctaccagaacgacaaacgccaaaagattcactgtaatctaacaactagaacagcctagggagaagtcgacagaccacggctagtattacngtgngaanagttgtaaaggaaaagtagtggnttggttgtttaagtggggcgaagggcgttccgtcggttctaaccccg

SEQ ID NO: 411327 - DNA, 564 bp, Homo sapiens
  misc_feature: GZ8MTXP01B1XAK.17.28.C06.1.454.CMB.2.raw
  modified_base (206)..(206): a, c, t, g, unknown or other
  modified_base (234)..(234): a, c, t, g, unknown or other
  modified_base (428)..(428): a, c, t, g, unknown or other
  modified_base (465)..(465): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggnagaggtcaccatatcttgttctgaaacngctccggcatctacaactaactattttgctggtaccagcaattcccaggactccggccccccgactccctcatctatagaaatgatcatccggcccgtccggggtccctgacccctattctctcgctcccatcgtctcggccaccctcacgccctccctgaccatcgaggtcgggctccggtcgaggatgagtntagtatttagttacgtgtcgcctacggtggatcgacnctccgtaggtacgtcgggtccgggtggttcgggcggacgggccgtaggcgttcgacccgtcgtaacgtcgaacgcccgaacggtccttccggtcccccg

SEQ ID NO: 411328 - DNA, 646 bp, Homo sapiens
  misc_feature: GZ8MTXP01AUP3W.17.28.C06.1.454.CMB.2.raw
  modified_base (206)..(206): a, c, t, g, unknown or other
  modified_base (236)..(236): a, c, t, g, unknown or other
  modified_base (244)..(244): a, c, t, g, unknown or other
  modified_base (261)..(261): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggnagaggtcaccatatcttgttctaggaaacngctccggnatctacaaactaaactnttttgctggaccagcaacttcccaggactcccggccccccactcctcatctatagaaatgatcacgtccggccccgttaccggggtcctgaccgtacttcctctcggacctccaattcgtctcggccacctcacgtccctcctcgaccctatccgacgggtcgggccttccgggtaccgagggtatgggacggtcttaagtactttaattcggtgttcggaccgtaccgggttaggggacttacggacctaacgttcccgtaggtaacgttcggggttcccgggtgggtttccggggacgggtacggggacccgagggtccgttcggttaccccggttcgttaaacgccgaacggccccgagggccctccgttccccccgttcgg

SEQ ID NO: 411329 - DNA, 683 bp, Homo sapiens
  misc_feature: GZ8MTXP01AFZC7.17.28.C06.1.454.CMB.2.raw
  modified_base (238)..(238): a, c, t, g, unknown or other
  modified_base (262)..(262): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcacgccaccctcagtgtctcgggacccccggagagggtcaccatatcttgttctaggaaacngctccggcatcacaaactaaactnttttgctggtaccagactaacttcccgaggactcccggccccccgatccctcatctaataagaaatgactcacgtcccggtcccgtccggggtccctcggaccccgtacttctcgtcggcctacccattcgtctcgggcctaccgtcacgtccctcccgtacgacctagtccgtagggtccgggtcccgttcccggggaccggtaaggtagtacgggacggtcttagtactttacggtttacgtggttcgaccgtaccgggttagggactacggtaactcgttcccgtaggtaacgggttcggggtaacccgggttgggttccggggacgggacgggtaccgacgggttcccgttcggttaaccccggttaactaaacggtccgaaccggacccgttacggtccccgttcccgtcccccgg

SEQ ID NO: 411330 - DNA, 662 bp, Homo sapiens
  misc_feature: GZ8MTXP01AN06W.17.28.C06.1.454.CMB.2.raw
  modified_base (210)..(210): a, c, t, g, unknown or other
  modified_base (241)..(241): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcacgcccaccctcagtgtcgtcggggacccccggnaggagggtcaccatatcttgttctagaaacngcctccggcatctacaaactaaactatttttcgctacggtaccagactaacttcccgaggactcccggcccccactccctcactactaataagaaatgatcacgtccggccccgttccgggtcctcggaccgtacttcctcgtcgcctcaagttcgtcgtcggaccctaccttcaccgtccctccgtacgaccctagtacgtacggtcgggtcccgttccgggtaccgagggtacgttggacgggtctaggtaactttacgttacgtggtcgtaccgtaccgggttgggaactcgaacgtacttccgtaggttaacggttcgggttccgggttggttccggggcgggaaaccgggcgtacggtcgttacggttaccgttcgttaacgcaaccgacccgacgggcctccgttccccgttccg

SEQ ID NO: 411331 - DNA, 604 bp, Homo sapiens
  misc_feature: GZ8MTXP01DJ6C1.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgaggtccggggagcctggtccagcgtgggggtccctgagactctcctgtgcagccctccggattccccttcagttagttatggatgacttgggtccgccagactccgagggagtgcgtggagtgggtcggaccaaacaagtaaagcaaagagtggaactcggaccgtagttttacgtggtacttcgtgtggaacgggtccctttacacctatctaccagacgacaacgaccaagaattacaactgtaactcaacaaactagaaacacgccgtagagtagtcgacagaccgacggtccgttgtattacgtggtgcgtagagttggaaaggtaaaaggtagttaggttcgttaggttgtttaggttcggggaccgaggggacgtcccgttgggtccccg

SEQ ID NO: 411332 - DNA, 681 bp, Homo sapiens
  misc_feature: GZ8MTXP01DDGNC.17.28.C06.1.454.CMB.2.raw
  modified_base (279)..(279): a, c, t, g, unknown or other
  modified_base (352)..(352): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgttttagaaggtgtccagtgtgaggtcagttggtgaggtcggggagctggtccagccgtgggggtccctgagactctcctgtgcagccctccggacttccccttnagtagttatggatgtacttgggccgcagactccgaaggggaacggggctgggaggtggggtacggacctaaanaagtaaaagcaaaggagtaggaaactcggtaccccgttaaggttttacgaggtacttcgtggttagggaacgggttcccgtttaccaaccctatcctaccgaagaacgaaccaaacgccaaaagtacttcaacttgtaattacctaaacaaactagaaacacgacctaggggaacgtacggtcgacgagaaccgcgggtccgttagttacttacgtggtcgacgtaagtaagttagggtaaaaggaaaaagttagtgggttacgttggtttaggttttaagggcgggggaaccgaggggtaccgttccccgttggttcccgtaaccccg

SEQ ID NO: 411333 - DNA, 665 bp, Homo sapiens
  misc_feature: GZ8MTXP01DWVDX.17.28.C06.1.454.CMB.2.raw
  modified_base (216)..(216): a, c, t, g, unknown or other
  modified_base (224)..(224): a, c, t, g, unknown or other
  modified_base (238)..(238): a, c, t, g, unknown or other
  modified_base (275)..(275): a, c, t, g, unknown or other
  modified_base (427)..(427): a, c, t, g, unknown or other
  modified_base (583)..(583): a, c, t, g, unknown or other
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttcctgttgctgttttagaaggtgtcagtgtgaggtcagttggtgaggtcggggngctggtcngcgtgggggtcccngagactctcctgtgcacgccctccggacttccccctnagttagttatggatggacgttgggtcccgccaggtaccgtccggaagggggaaggggtcgtaggggaggttcgggggtacgggacctaaaacgtaagtaaaacggcgtaaagacgttagggaaactcggtaccccggttaggtttttacggnggtacttcgtggtaggtaacggggtcctttacaccgtactcctaccgaggaacaccaacgaccaaagtaacttctaacgtagtactactaaacaactagaaacagccaggggagaacgtcgacgacgaccgcggtccgttagtattacgtgtcggngaagtattagggtaaagaaaagtgtacgttgttggttagtttgggtcgggcgtaagggccggttccttaaggttctaacccg

SEQ ID NO: 411334 - DNA, 653 bp, Homo sapiens
  misc_feature: GZ8MTXP01C2LYS.17.28.C06.1.454.CMB.2.raw
  modified_base (280)..(280): a, c, t, g, unknown or other
  modified_base (307)..(307): a, c, t, g, unknown or other
  modified_base (551)..(551): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggagcctggtccagcgtgggggtccctgagactctcctgtgcacgccctccggacttcccctnagtagttatggatgtacgttgggtccnccagctaccgaggggaggggctgggaggtgggtcggaccaaacgaagtaaacgacgaagagtaggaactcgacccggttagttttacgtggtacttcgtaggttacggaacggggtccctttacaacctatccctaccaagaacgaaccaacgaacccaaagtaacttccatagtactctaaacaactagaaacagcctagggacgtaggtccgacagaaccgacggtccgttgtaacttacgngtgcgaagtagttagggtaaaggaaaagttacgtggttagtttgttaggtttaaggtcggggtccaagggggtccttcccggttaagttccccgtaacccgg

SEQ ID NO: 411335 - DNA, 596 bp, Homo sapiens
  misc_feature: GZ8MTXP01D6YOR.17.28.C06.1.454.CMB.2.raw
  modified_base (209)..(209): a, c, t, g, unknown or other
  modified_base (238)..(238): a, c, t, g, unknown or other
  modified_base (259)..(259): a, c, t, g, unknown or other
  modified_base (342)..(342): a, c, t, g, unknown or other
  modified_base (346)..(346): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcacgcccaccctcagtgtcgtcgggaccccggnaggaggtcaccatatcttgttcagaaacngctcgcatctacaactaactnttttgctgtacagcaactcccaggctccggccccccatcctcatactatagaatgatcatccggccctccggggccctgaccnttcncgtgctccatcgctggccacctcgacgccctccctagacccagtcagggtcggaccttcccgggtacgaggatgagtctagtactttagtactggtcgaccgtacggtggaacttgaaccgtgttcccgtaggtaacgtttcggggtaacccgggttgttcgggggcccggttaaagggacccgaggttccgttcggttacccgttaaccgtaagtccgaacgacccgaacggtcccgttcccgtccccg

SEQ ID NO: 411336 - DNA, 660 bp, Homo sapiens
  misc_feature: GZ8MTXP01AEPWQ.17.28.C06.1.454.CMB.2.raw
  modified_base (280)..(280): a, c, t, g, unknown or other
  modified_base (355)..(355): a, c, t, g, unknown or other
  modified_base (408)..(408): a, c, t, g, unknown or other
  modified_base (510)..(510): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgttttagaaggtgtccagtgtgaggtcagttggtgagtccggggagcctggtccagccgtgggggtccctgagctctcctgtgcagccctccggactttccccttnagttagttatggatgacgttgggtccgccgagactccggaggggaaggggctggggaggtgggtacgacccaaanaagtaaacgcgaaagtagtaggaaacgtcgtacccccggttaggttttacggnggtacttcgtaaggtacggaacgggttcccgtttcaccgtactcctacgagaacgaccaacgaaccaagtacttcacttagaactcgtaaacacgtagaacncgtccgtaggagacggtccgacgaagaccgtcggaccgtttgtaacttcgtgtcggcgtaagtagttaggtaaaaggaaagttagtggttacgttggttagttttaagggcgggaaccgagggtcccgttaccgtggttccctaacccgg

SEQ ID NO: 411337 - DNA, 606 bp, Homo sapiens
  misc_feature: GZ8MTXP01CA6X9.17.28.C06.1.454.CMB.2.raw
  modified_base (279)..(279): a, c, t, g, unknown or other
  modified_base (302)..(302): a, c, t, g, unknown or other
  modified_base (339)..(339): a, c, t, g, unknown or other
  modified_base (376)..(376): a, c, t, g, unknown or other
  modified_base (381)..(381): a, c, t, g, unknown or other
  modified_base (517)..(517): a, c, t, g, unknown or other
tcagcgtagactagcacgaccggtgctcgatttagagctcacgtattgggtttggggaggtctcagagaggaggcttagccctggctccaaggcctttccacttggtgatcagcactgagcacagaggactcaccatggagttggggctgaactgggttttccttgttgctgttttagaaggtgtccagtgtgaggtccagttggttgagtccgggggagcctggtccagcctggggggtccctgagactctcctgtgcagcctccggattcccccttnagtagttatggatgacttggccncagactcgagggaaggggctggagtgggtgaccaaanaataaaagcaaagatggaactgacccgtagttttagngactntggtagaacgggtcctttcaccctatcctcgaagagaaccaaacgaccaaagtaatactactagtatactacaaactagaacgacgaccgtacggagtagtcgacgagacgacggcggtacgtagttacgtagtgngaagagttaggtaaggaaaaggtaaagtaggttgttgttggtttaaggttggggtcgggacgggtacggacccgtccggttcgtaaccg

SEQ ID NO: 411338 - DNA, 688 bp, Homo sapiens
  misc_feature: GZ8MTXP01DIV2E.17.28.C06.1.454.CMB.2.raw
  modified_base (272)..(272): a, c, t, g, unknown or other
  modified_base (300)..(300): a, c, t, g, unknown or other
  modified_base (340)..(340): a, c, t, g, unknown or other
  modified_base (622)..(622): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttgggctgaacttgggttttccttgttgcttgttttagaaggtgtcagtgtgaggtcagttggttgaggtcggggagctggtcagccgtgggggtcctgagactctctgtgcacgcctccggtacttccccttnagttagttattggatgacgttgggtccncagactcgaaggggagggcgtggagtgggtacgaccaaanaagtaaaagcaaagagtaggaaactggtaccggttaagtttttacggaggtaccttgtaggtaacgggtaaaccgggttccgtttaccaaccgtactcctaccgaagacgaaaccaacgacctaaaagtacttcaacttgtaacttacctaaactaacgtacgaaacgacgtccgtaggaaacggtacgtaccggaacgaaggaaccgaccgggtccgtttagttacgttaacgtggtcgaacgtaagtaagttaaggaaaacgggtaaaaagttgtcggtnttagggtttacggtttaggtcggggaccgtaaggggacctccgttcgggtaacccaacccgttccc

SEQ ID NO: 411339 - DNA, 663 bp, Homo sapiens
  misc_feature: GZ8MTXP01BMZIG.17.28.C06.1.454.CMB.2.raw
  modified_base (243)..(243): a, c, t, g, unknown or other
  modified_base (277)..(277): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcacgcccaccctcagtcgtcgtcggggacccccgggcaggaggtcaccatatcttgttctaggaaacngctccgcatctacaaactaactatttgctgtacngacatcacgagctccggcccccactcctcatctaataacgaaatgactcacgtcccggtcccgtccgggtcctcgacccgtctctcgtcgcctacctatcgtctcggaccctacctccgacctccctccctacgtaccctagtccgtacgggtccggggtccgtacccgggtaccgggagtaacgtgaacgggtcttagtaaacttttacggttacgttcggtccgtaccgtacggggtcggaattcgaaccgtcgttcgaacggttacggttccgggtaaccggggtttcggttcgggggaacggacgggaccgtacgggccgttccggttaacccgtccgttaacgcccgacggacccggttacgtcccgttcccgtcccccgg

SEQ ID NO: 411340 - DNA, 670 bp, Homo sapiens
  misc_feature: GZ8MTXP01DGGWH.17.28.C06.1.454.CMB.2.raw
  modified_base (243)..(243): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcggggacccccgggcaggagggtccaccatatcttgttctaggaaacngctccggcatctacaaactaaactattttgctaggtaccagactaacttcccgaaggacctccggccccccgactccctcatctaataagaatgatcacgtccggccccgtccgggtccctcgacccctattctcgtcggctccattcgtctcggacctacccgtcacgtccctccctcgaccactcgaggtcgggtcccgtacccgggtccgaggtagtcggacgtcgtagttaacgtttattaccgtggtacgtaccgtaccgggttggtactcggtaacctacgttccgtagggtaacgttcgggggttaacgggttcgggttcgggggacggggacgggtaccggagggttaccgttcggttaaccccggttaacgtaaacggtccgaccggacccgacggtcccgttcccggtaacccccgg

SEQ ID NO: 411341 - DNA, 686 bp, Homo sapiens
  misc_feature: GZ8MTXP01E1DNK.17.28.C06.1.454.CMB.2.raw
  modified_base (285)..(285): a, c, t, g, unknown or other
  modified_base (318)..(318): a, c, t, g, unknown or other
  modified_base (592)..(592): a, c, t, g, unknown or other
  modified_base (678)..(678): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgctgttttagaaggtgtccagtgtgaggtccagttggttgagtccggggagcctggtccagccgtggggggtccctgagactctcctgtgcagtccctccgggacttcccccttnaggttagttatggatgtacgttcggggtccccnccgacggtacccccgaggggaagggggcggtcggaggtggggtacgggacccaaaacaataaaacgacaaaggagtaggaaccgtggtaccggtacggtttttaacggtggtactccgtggtaacgggtaaacggggtccgtttacccaacccatcctacgaacggacaaaccgaacccgtaaccgaaacgaaacttacaacgttagtactaccttaacaaacgagaacaacggcctaggacggtacgccggcaacggaccgtaccggccggtnttaagtcgtgtgacgagaagtagaaggtaaaacgttagtggtaacgttgttaggttgttcggggcgtaaggccgccgttcggtccncccggtcc

SEQ ID NO: 411342 - DNA, 668 bp, Homo sapiens
  misc_feature: GZ8MTXP01C07HB.17.28.C06.1.454.CMB.2.raw
  modified_base (396)..(396): a, c, t, g, unknown or other
  modified_base (498)..(498): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtccagtgtgaggtccagtggtgaggtccggggagctggtccagccgtgggggtccctgagactctcctgtgcagccctccggacttccccttcagtagttatggatgtacgttgggtcccgccagactccgaggggaaggggctagggaggtggggtcggaccaaacagttaaagacaaggataggaactggaccccggttagttttacggnggtactcgtaggtaggaagggtccctttacgaccctatcctacagacgaccaacgacccaaagtaacttcaacgttgtaaccttactaacgaactagaaacncgtacccgttaggacggtaacgtccgacgtaggaaccgaccggtcgttacgtattacgtgtcgcggtaagtagttaggtaaaggaaaagttagtcggggttatttgggtttggtttaaggttcgggggaaccgaggggtaccgttcccgtttaacggttcccgtaacccg

SEQ ID NO: 411343 - DNA, 632 bp, Homo sapiens
  misc_feature: GZ8MTXP01DIK8O.17.28.C06.1.454.CMB.2.raw
  modified_base (279)..(279): a, c, t, g, unknown or other
  modified_base (394)..(394): a, c, t, g, unknown or other
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggagcctggtccagcgtgggggtccctgagctctcctgtgcagccctccggattccccttnagttagttatggatgacgttgggtccgccagactccgaaggggaggggctgggaggtgggtcggaccaaacgaataaagcaaagagtaggaactcgaccccgttagttttacggnggtaactcgtgggtaggaacggggtcccgtttacaccctatcctaccaggacgaacaacgaccaaagaacttcactagtatactaacaactagaacagtccgtagggacgagtcgacaagaccgacggtccgtagttactacgtgtgacgaagtagttaggtaaaggaaaagttaggtgttagttggttaggtttaagtagggggcctaggggaccgttcccggtgttccgtaacccg

SEQ ID NO: 411344 - DNA, 565 bp, Homo sapiens
  misc_feature: GZ8MTXP01BEUAZ.17.28.C06.1.454.CMB.2.raw
  modified_base (205)..(205): a, c, t, g, unknown or other
  modified_base (234)..(234): a, c, t, g, unknown or other
  modified_base (364)..(364): a, c, t, g, unknown or other
  modified_base (374)..(374): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctaaccctcctcactcactgtgcagggtcctgggcccagtctgtgctgactcagccaccctcagtgtctgggacccccggnagagggtcaccatatcttgtctggaaacngctcggcatctcaaactaaacatttttgctggtaccagcaattcccaggactccggccccccgatcctcatactatagaaatgactcatccgccctccggggtccctgaccgattccctctggctccatntctgcacctnacgcctccctgacccactcagtcgggctccgggtccgagggatcgaggctgattatactggtgcaccgtgggatgacatcctgaagtggtccggtgttccgggcggacgggaccaggcttcggacccgttccgttaacggtaaccacggccccgaaagggtccgttacccggtccccccgttcgggtcccc

SEQ ID NO: 411345 - DNA, 570 bp, Homo sapiens
  misc_feature: GZ8MTXP01BDBXE.17.28.C06.1.454.CMB.2.raw
  modified_base (278)..(278): a, c, t, g, unknown or other
  modified_base (447)..(447): a, c, t, g, unknown or other
  modified_base (551)..(551): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagccctccggattccccttnagtagttatggatgacttgggtccgcagacctccgaggggaaggggctgggagtgggtggccaacataaagcaagatggaactgcccgtaggttttacgtggactcgtagtgaacgggtccgtttcacctatctacagacgacaacgccaagatcactgatcacaactnaacagacctggagagtcgcagaccacggccgttagtactactgtgcgaagattggtaacggaaaagtaagtggacttgttagtttaagtggggtaaccaggggncccgtggttccgtaacccg

SEQ ID NO: 411346 - DNA, 689 bp, Homo sapiens
  misc_feature: GZ8MTXP01BT51K.17.28.C06.1.454.CMB.2.raw
  modified_base (212)..(212): a, c, t, g, unknown or other
  modified_base (230)..(230): a, c, t, g, unknown or other
  modified_base (263)..(263): a, c, t, g, unknown or other
  modified_base (378)..(378): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcttgttgctgttttagaagtgtcagtgtgagtcagttggtgagtcggggngctgcagcgtggggtccngagactctctgtgcagcctccggacttcccctnagtagttatggatgtacgttggtccgcacgctacgaggggaggggctgggagtggggtacgaccaaacaagtaaacgcaaagagtaggaaactggtaccccgtagtttttacggnggtactcgtaggtacgaacggggtcctttaccaccgtactcctaccgaagacgaaccaaccgacctaaagtaactttaccaacgttacgttactaacctaactaaactacgaaacacgtccgttaggggaacggacggttccgacgaacggaacccgtaccgggtacccgtttagttaactttaacgtggtacgtcggaaagtgttaaacgggtaaagggttaaaaagtaggttagggttcgttgggtttacggtttaagggttcgggggaaccgtaggggaccgttcccggtcggttaaccgtaaccccg

SEQ ID NO: 411347 - DNA, 676 bp, Homo sapiens
  misc_feature: GZ8MTXP01D8JPH.17.28.C06.1.454.CMB.2.raw
  modified_base (272)..(272): a, c, t, g, unknown or other
  modified_base (405)..(405): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgctgttttagaaggtgtccagtgtgagtcagttggttgaggtcggggagctggcagcgtgggggtcctgagactctctgtgcagccctccggacttcccctntagtagttatggatgtacgttcgggtccgccaagaacgtaccggaaggggaagggggcgtaggggacggtggggtacggaccaaacgaataaaagacgagtagtaggtaacgtcgtaccgtttaggtttacgngtactcgtaggtaggtaacggttccttacgactactccaacgacgaaacaccgtaacgaccgtaaatactatacttagttactacaactaagtacgaaacgacgtacgtaggggaacgcgtcgaacgaaccgacggtcccggttagtagtttactagtggtcgaagtaataggttaacgggtaaagaaaagttacgtgggttgtttagggtttagtttcggggacggggtaacggaacgggtcccttaccgggtcgttaacccgtaacccg

SEQ ID NO: 411348 - DNA, 610 bp, Homo sapiens
  misc_feature: GZ8MTXP01BC1UA.17.28.C06.1.454.CMB.2.raw
  modified_base (279)..(279): a, c, t, g, unknown or other
  modified_base (304)..(304): a, c, t, g, unknown or other
  modified_base (555)..(555): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagccgtgggggtccctgagactctcctgtgcagccctccggattccccttnaatagttatggatgacttgggtccnccagactccgaggggaggggctgggagtgggtggaccaacagtaaaagcaaagatggaaactggaccccgtagttttacgggtactcgtagtaggaacgggtcccgtttcaccctatcctacccagaacgaccaaacgaccaaagtaacttcaactagtaataactaaaactgaaacagcctgaggagtcgacagacacggccgttgtattacgtgtgcgagtaataggttaaggtaaaaagttagtggtnttggttgtttaggttgggggcctaagggggcgtcccgttggtcccgccgttcccg

SEQ ID NO: 411349 - DNA, 594 bp, Homo sapiens
  misc_feature: GZ8MTXP01EE20T.17.28.C06.1.454.CMB.2.raw
  modified_base (217)..(217): a, c, t, g, unknown or other
  modified_base (239)..(239): a, c, t, g, unknown or other
  modified_base (271)..(271): a, c, t, g, unknown or other
  modified_base (369)..(369): a, c, t, g, unknown or other
  modified_base (403)..(403): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggtgaggtcggggngctggtcagccgtgggggtccngagctctctgtgcagccctccggattcccctnagtagttatggatgtacttgggtccgccagactccgaaggggaggggctgggagtgggtgaccaacataaagcaagatggaactgcccgtagtttagnggactctgtgaagggtccgtttcacatctcaganacaacgcaaagattcatgtatctaacactacgaacaacgcctagggagagtccgacgagaccaccgggtccgtagttacttactggtgcggaagtagttagggtaaaggaaaaaagttagtaggggacctttgggttagttttaaggtcgggggaaccagggggacgttcccgtgggttaacctaacccgg

SEQ ID NO: 411350 - DNA, 653 bp, Homo sapiens
  misc_feature: GZ8MTXP01EPD1Y.17.28.C06.1.454.CMB.2.raw
  modified_base (209)..(209): a, c, t, g, unknown or other
  modified_base (260)..(260): a, c, t, g, unknown or other
  modified_base (383)..(383): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcacgccaccctcagtgtcgtcgggacccccggnagaggtcaccatatcttgtctagaacagtcctcgcatctacaaactaactnttttcgctacggtaccagactaacttcccgaggtacctccccggaccccctactcctacattctaataacgaaatgactctacgtccggtacccgtccgggtccctcgtaaccccgtcttacncgtcgtcctactatcgtactcggcctacccgtcaaccgtcccttacccgtacgaccctaagtcgcgggtccggtacccgttacccgggacgtaacggacttaggacggttactagggttaacttttacggtaacgttcggtacgaccgggtacgtagggtactagtacgaactccgtagtagtcggtaaccggtgggttcggacgggttagaccgtcggcgttccggacgtaacgacgtcacggacccttagcccgttccgtaacccccg

SEQ ID NO: 411351 - DNA, 707 bp, Homo sapiens
  misc_feature: GZ8MTXP01DEZ50.17.28.C06.1.454.CMB.2.raw
  modified_base (210)..(210): a, c, t, g, unknown or other
  modified_base (241)..(241): a, c, t, g, unknown or other
  modified_base (460)..(460): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcacgcccaccctcagtgtcgtcgggacccccggnaggacggtcaccatatcttgttctagaaacngcctccggcatctacaactaaactatttgctggtaccagactaacttcccgaggtaccgtccccggcccccccgtactccctctactaccttaaataaagtaaatcgaactacgacgtcccggtcccccgttcccgggggtccctacggtacccccgtactttccgtcgtcggtcccttcccgtagttcgttacgtccgggtaccctaccccgttaccnccgtccccttacccctaccgtaccctaacgttccggtacgggttccggggtacccgttcccggggtacccggtagggtagtacggacggtcgttaagttattttacgttaacgttggtcgtacgtaccggtggtactagaactcgtccgtagtacggttgggtccggttgggttccggggcgggttacggaccgtaggttcgttcgaccgtcgtaacgtcgacgccgacgtcccgttcccgtccccg

SEQ ID NO: 411352 - DNA, 641 bp, Homo sapiens
  misc_feature: GZ8MTXP01CPHP7.17.28.C06.1.454.CMB.2.raw
  modified_base (244)..(244): a, c, t, g, unknown or other
  modified_base (279)..(279): a, c, t, g, unknown or other
  modified_base (479)..(479): a, c, t, g, unknown or other
  modified_base (541)..(541): a, c, t, g, unknown or other
  modified_base (547)..(547): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgctgttttagaaggtgtccagtgtgaggtcaggttggtgaggtcggggagcctggtccagccgtgggggtcccngagctctcctgtgcacgccctccgtacttcccctnagttagttatggatcgtacgttcgggtccgccagacgtccggaaggggaggggcgtgggaggtgggtacggaccaaacaagtaaacgacgaagataggaactggtacccgttagtttacgtgactcgtagtaggtaacgggtccgtttacactactcacgagaacacaacgacaaagtactcactagtactacaactaanacaacacgtcctagggaacgtacggtccgacgaacgaccgccggtcgttagttatttaccgnggtcgngaaagtagttaggtaaaagaaagttacgtggttgtttgttaggttttaaggccggggaacgaacggggtcttccccgttgggttccctaacccg

SEQ ID NO: 411353 - DNA, 704 bp, Homo sapiens
  misc_feature: GZ8MTXP01DGXRY.17.28.C06.1.454.CMB.2.raw
  modified_base (276)..(276): a, c, t, g, unknown or other
  modified_base (302)..(302): a, c, t, g, unknown or other
  modified_base (332)..(332): a, c, t, g, unknown or other
  modified_base (347)..(347): a, c, t, g, unknown or other
  modified_base (384)..(384): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgctgttttagaaggtgtccagtgtgaggtcagttggttgaggtcggggagcctggtccagccgtgggggtccctgagctctctgtgcagccctcggacttcccctnagtagttatggatgtacttgggtccnccagacctccggaaggggaaggggctgggngtgggtcggaccaanataaagcaagatggaactgtccccgtaggttttacgnggtacttcgtaggtacggaacggggttcctttacgaccctatcctaccgaggaacgaacctaacggacccaaagtaacttaccaatttacgtactttacaaacctaaaccgttagaaaacctacgtacccgttaggggaaacggtacggttaccgaccgaacggaacccgtacccggggtccgtttaagttacgtttacgtaggttcggacggtaaggtaagttagggtaaaaggttaaaacgttagtacgggttgtttggttaggttttggtacgggggccgaggggtacccgttcccgttaacggttcccgtaacccg

SEQ ID NO: 411354 - DNA, 627 bp, Homo sapiens
  misc_feature: GZ8MTXP01EVW6L.17.28.C06.1.454.CMB.2.raw
  modified_base (413)..(413): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggcagagggtcaccatatcttgtctggaaacagctccggcatctcaaactaaactattttgctggtaccagtcaacttcccaaggactccggccccccgactccctcactctataagaatgatcactccggtcccctccgggggtaccctcggaccccgattctctcggcctacacttgtctcgggcctacctcgacgcccttcccgtnacccatcgaggtcgggcgttcccggtccgaggactggacgtctagtaattacgttacgttgtcgtcaccggtgggattcggaactacgtccctagtacgtcggggtaacccggttggttccggggcgggttaacgggtaccgtagggccgttcgggacccgttccgtaacggtaaccaacgggtccccgaaacggtcccgttcccggtcccccg

SEQ ID NO: 411355 - DNA, 721 bp, Homo sapiens
  misc_feature: GZ8MTXP01EUE8U.17.28.C06.1.454.CMB.2.raw
  modified_base (385)..(385): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggagcctggtccagccgtgggggtccctgagactctcctgtgcagcctccggacttccccttcagtagttatggatgtacgttcgggtccgccagacctcgaggggaggggctgggagtgggtgaccaagaataaagcaagataggaactcgacccgtagttttacgnggtactcgtaggtacggaacggggtccctttacacccgtattcccgtacccgaagggaaacgaacccgtaaacgacccgtaaaaggtaaactttccaaacgttacgttaaacttacctaaaccaaaccgttagaaaccacgcccttaggggaacggtagttacccgacgaacggacccaaaccgggggttcccttagttaacttaccgtggtacggacggtaaggtattaagggtaaaggaaaaagtttaggtgggttacgtttgggttacgggttttaaggtggggggaacccgtagggggaccgttcccgttaacggggttccctaaccccggg

SEQ ID NO: 411356 - DNA, 631 bp, Homo sapiens
  misc_feature: GZ8MTXP01EAEVT.17.28.C06.1.454.CMB.2.raw
  modified_base (304)..(304): a, c, t, g, unknown or other
  modified_base (343)..(343): a, c, t, g, unknown or other
  modified_base (377)..(377): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggagcctggtccagccgtgggggtccctgagactctcctgtgcacgcctccggattcccctcagtagttatggatgacttgggtccnccagactccgaggggaggggctgggagtgggtgccaaanataaagcaagatggactgccccgtagttttacgngactcgtagtgaagggtcctttcacctatcctaccagacgaacaacgaccaaagtacttacgacttagtactactaacaactacgaaacacgcccgttagggaacggtagtaccgcgaacggaccgacgggtccgttagttaacttaccgtgtggcgaagtagttaggtaaaggttaaaagtatgggttacttggtttaggtttaaggttgggggaacccgtaaggggccgttcccgttggttcccgtaacccg

SEQ ID NO: 411357 - DNA, 620 bp, Homo sapiens
  misc_feature: GZ8MTXP01A9OAX.17.28.C06.1.454.CMB.2.raw
  modified_base (270)..(270): a, c, t, g, unknown or other
  modified_base (319)..(319): a, c, t, g, unknown or other
  modified_base (377)..(377): a, c, t, g, unknown or other
  modified_base (526)..(526): a, c, t, g, unknown or other
  modified_base (566)..(566): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtcagtgtgagtcagttggtgagtcggggagctggtccagccgtgggggtcctgagactctcctgtgcagcctccggacttcccctnagtagttatggatgacgttggtccgcagactcgaggggaggggctgggngtgggtgaccaaacaataaagcaaagagtaggaaactcggtacccgtaggttttacgnggactcgtaggtagaacgggtccgtttacacctatcctaccaagacgaaccaacgaccaaagtacttcaacttagtaactactaacaaactagaaactagccttagggaagtacgtaccgacgagacccgcggtcgttagttattacgngtagcgaagtattagggtaaagttaaaacgtagtcggttnttggttacgtttaaggggtcgggaacgagggggtcttcccgtggcccgtaaccg

SEQ ID NO: 411358 - DNA, 606 bp, Homo sapiens
  misc_feature: GZ8MTXP01EPDQT.17.28.C06.1.454.CMB.2.raw
  modified_base (270)..(270): a, c, t, g, unknown or other
  modified_base (295)..(295): a, c, t, g, unknown or other
  modified_base (372)..(372): a, c, t, g, unknown or other
  modified_base (433)..(433): a, c, t, g, unknown or other
tcagcgtagactagcacgaccggtgctcgatttagagctcacgtattggggtttggggaggtctcagagaggaggcttagccctggactccaaggcctttccacttggtgatcagcactgagcacagaggactcaccatggagttggggctgaactgggttttccttgttgctgttttagagtgtcagtgtgaggtcagttggttgaggtcggggagctggtccagccgtgggggtcctgagactctctgtgcagcctcggattcccctnagtagttatggatgacttgggtccncagactcgagggaggggctgggagtgggtggaccaaacaagtaaagcaaagataggaactgaccccgtagtttacgngactcgtagtagaacgggtccttcacctatctcgagacgacaacgacaagactcaacgttntaactactaacaaactagaaactacgcctagggaaggacgtcgacgaagaccgtcggcgttagttaacttagtggtgaggtaagtagttaaggaaaggttaaaaagtagtcggttgttggttaggtttaaggtcggggaaccgtggggaccttccgttaaggttcctaacccg

SEQ ID NO: 411359 - DNA, 626 bp, Homo sapiens
  misc_feature: GZ8MTXP01APCX2.17.28.C06.1.454.CMB.2.raw
  modified_base (298)..(298): a, c, t, g, unknown or other
  modified_base (367)..(367): a, c, t, g, unknown or other
  modified_base (372)..(372): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggtttccttgttgctgtttagaaggtgtccagtgtgaggtccagttggttgaggtcggggagcctggtccaggccgtgggggtccctgagactctctgtgcagcctccggacttcccctcagttagttattggatgacttgggccncagctccaggggagggctggagtgggtggaccaaacataaagcaagataggaactgccgtagtttacgngactntgtagacgggtcttcgactatctacagacacaacgcaaagattcgactgtatctacaactgaaacagcctagaggtagtacgcaacggaaccgacggccgttagttactttaacgtggtgcggaagtaagttaggttaaagggtaaaaaagttagttagggtacgtttaggttgggtttttaaacggttcggggggaccccgtaagggggtaaccggtccccgttcgggggtaacccttaacccggtttccccg

SEQ ID NO: 411360 - DNA, 557 bp, Homo sapiens
  misc_feature: GZ8MTXP01CR9O1.17.28.C06.1.454.CMB.2.raw
  modified_base (377)..(377): a, c, t, g, unknown or other
  modified_base (543)..(543): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggctggtccagcctgggggtccctgagactctcctgtgcagccctccggattccccttcagtagttatggatgacttgggtccgccagactccgaggggaaggggctggagtggggtggccaacataaagcaagatggaactgccccgagttttacgnggtactctgtgaagggccgtttcaccgatctccagagacaacgccaagatcactgtatctacaactgaacagacctggagagtcgacagacgacggcgttagtattacctgtcgcgaagattggtaaggaaaagtagtggattgttgtttaagtggggcaggggcnccgtggctaacccg

SEQ ID NO: 411361 - DNA, 637 bp, Homo sapiens
  misc_feature: GZ8MTXP01C7B1E.17.28.C06.1.454.CMB.2.raw
  modified_base (279)..(279): a, c, t, g, unknown or other
  modified_base (403)..(403): a, c, t, g, unknown or other
  modified_base (543)..(543): a, c, t, g, unknown or other
tcagcgtagactagcacgaccggtgctcgattttagagctcacgtattgggtttggggaggtctcagagaggaggcttagccctggactccaaggcctttccacttggtgatcagcactgagcacagaggactcaccatggagttggggctgaacttgggtttttccttgttgtcttgttttagaaggtgtccagtgtgagtcagttggtgaggtcggggagctgtccagccgtggggtcctgagctctcctgtgcacgtccctccgtacttccccttnagttagttatggatgtacgttcggtcccgaccagacgtccggaaggggacggggcgtagggaggtggggtcggaccaaagtaactaaagacaagagtaggactcggtaccccgtagttttacgngactcgtgtaggtaacggtccttacactactacctacaacgacaacaacgaccgaaatattaccacgtatactactaacgatagaacacgtaccgtagggagtacgcgacaggaccgtccggtcgttattagtttacggngtcgaggaagtagttaaggtaaagttaaagttgtcggttagtttggtttacggttaagggtcgggcgtacgggcgttccgtcgttaaccgtccg

SEQ ID NO: 411362 - DNA, 666 bp, Homo sapiens
  misc_feature: GZ8MTXP01A107Z.17.28.C06.1.454.CMB.2.raw
  modified_base (237)..(237): a, c, t, g, unknown or other
  modified_base (260)..(260): a, c, t, g, unknown or other
  modified_base (428)..(428): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtcgtcggggacccccggcaggaggtcacatatcttgtctgaaacngctccggcatctcaactaaactnttttgctgtacagcaacttccagactccggcccccgatccctcactctaataagaaatgactacacgtccggccccttccgggggtccctacgtaccccgtactttcgtcgtcggcctaccgtattcggtcctgggccctaacctccacgccctccctacgacctacncgtacggtcgggccgttcccgggtaccgaggtacgtcggacggtacttagtatttacggttacgttggtcggtaccgtaaccgggtcggtagtacgaaccgtacgttcccgtaggtaacgttcggggttaacccggttgggttaccggggtcgggaacgggtaccgacgggttcgttccgggttaaccgtccgtaaacgccgacgtacccgttacggcccgttaacccggtcccccgg

SEQ ID NO: 411363 - DNA, 624 bp, Homo sapiens
  misc_feature: GZ8MTXP01BOSVL.17.28.C06.1.454.CMB.2.raw
  modified_base (276)..(276): a, c, t, g, unknown or other
  modified_base (392)..(392): a, c, t, g, unknown or other
tcagcgtagactagcacgaccggtgctcgatttagagctcacgtattgggtttggggaggtctcagagaggagacttagccctggactccaaggcctttccacttggtgatcagcactgagcacagaggactcaccatggagttggggctgaactgggttttccttgttgctgttttagaaggtgtccagtgtgaggtcagttggttgagtcggggagcctggtccagccgtgggggtccctgagactctcctgtgcagccctcggattccccttnagtagttatggatgacttgggtccgccagactccgaaggggaggggctgggagtggggtacggaccaaacaagtaaaacgcaaaggataggaaactggaccccgtaggttttacgnggactgtagttaggaacgggtcctttcactactctacagacgacaacgaccaaagtaacttcaacttagtactacaacaactagaacagcctaggagacgtcgacaagtaccgacggcgttagtactctggtgcgaagtagttaggtaaacggaaaaagttactgggcgttggttaggttttaaggtcgggggaaccaaggggtcgttcccgttgggttaaccctaacccgg

SEQ ID NO: 411364 - DNA, 649 bp, Homo sapiens
  misc_feature: GZ8MTXP01A6A9B.17.28.C06.1.454.CMB.2.raw
  modified_base (349)..(349): a, c, t, g, unknown or other
  modified_base (386)..(386): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgagtccagttggttgaggtccgggggagcctggtccagccgtgggggtccctgagactctcctgtgcacgcctccggacttccccttcagtagttatggatgtacgttgggtccgcagacctccgaggggaaggggctgggagtgggtggaccaanaataaagcaagataggactgacccgtagttttacggngtactgtggtagaacgggtccgtttacaacctatcctacgaagacgaaccaaccggaccaaagtaacttaccaacgttagtaacttctaaaccaaacttacgaaaccagcccgtagggaacggtacggtaccgacgacgaaccgaccggtacccgtaggttacttacgtggtcgacggaagtagttaggaaagggttaaaagtagtggttcgttggttagtttaacgggtggggcctaggggacgcccgtggttccgtaaccg

SEQ ID NO: 411365 - DNA, 595 bp, Homo sapiens
  misc_feature: GZ8MTXP01BNWE1.17.28.C06.1.454.CMB.2.raw
  modified_base (187)..(187): a, c, t, g, unknown or other
  modified_base (207)..(207): a, c, t, g, unknown or other
  modified_base (360)..(360): a, c, t, g, unknown or other
  modified_base (485)..(485): a, c, t, g, unknown or other
tcagcgtagactagcacgaccggtgctcgatttagagctcacgtattgggtttggggcagcttcagctgtggtagagaagacaggattcaggacaatctccagcatggacggcttccctctcctcctcaccctcctcactcactgtgcagggtcctgggcccagtctgtgctgactcagccaccctnagtgtcgtcgggaccccggnagaggtcacatatcttgttctaggaacagctccggcatcacaaactaactattttgctggtaccagcaacttccgaggactcccggccccccactcctacactacgtataagaactgactcagtccgcccgtaccgggtccctagaccccgtnttctctcgcctacatgtctcgccctaccctcgacgtcccctcccgtacaccagtcgcggttcggccgttacccgggagtacgagtcgacgctagttaacttggttactcggtactcgacgtaggntgaaccagtccgagtacgtcgggtccggtcgttcggggacggacggtacgcggttcgccgttaaccgtcctaaaggtcaccggaaccggttcggtcccttcccgcccccg

SEQ ID NO: 411366 - DNA, 701 bp, Homo sapiens
  misc_feature: GZ8MTXP01CD82R.17.28.C06.1.454.CMB.2.raw
  modified_base (276)..(276): a, c, t, g, unknown or other
  modified_base (403)..(403): a, c, t, g, unknown or other
  modified_base (519)..(519): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaacttgggttttccttgttgcttgttttagaaggtgtccagtgtgaggtcagttggtgaggtcggggagctggtccagccgtgggggtccctgagactctcctgtgcagccctccggtacttccccttnagttagttagttggatgacgttgggccgccagacctccggaggggaaggggctgggaggtggggtacggaccaaacgaataaaacggcaaaggagtaggaaactggaccgttaaggtttttaccggngtaccgtgtggtaacggaacgggttcccgtttacaaccgtatcctaccgaaggtaacgaaccaaaccgacctaaaggtaacttctaacttagtaactactaacaacgtagaaacgngacctaggaacggacgtcgacaacggaccgtaccgggtaccgttagttaacttacgtggtacgacggtagtaagttaggttaaagggtaaaaagttagtagggtactttgggtttaggtttacgggttcgggggacccgtaaggggtaccgtcccgttcggtaacccgttccggttaacccg

SEQ ID NO: 411367 - DNA, 742 bp, Homo sapiens
  misc_feature: GZ8MTXP01CPE28.17.28.C06.1.454.CMB.2.raw
  modified_base (209)..(209): a, c, t, g, unknown or other
  modified_base (241)..(241): a, c, t, g, unknown or other
  modified_base (686)..(686): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccgggnaggagggtcaccatatcttgttctaggaaacngctccggctatctactaactaaactattttgctaggtaccagctaaacttccgaggtacctcccggcccccactcctacatctaatagaaatgatcacgtcccggtcccgtccggggtcctacgtaccccgtattcgtcgtcggcctacccgattcggtcctcgggtacctaccctccgaccggtccccttcccctacggacccctacgtaccgggtacgggttcccggggtacccgggttaccccgggggttacccgggtaaggggtaacgttcggggtaaacgggtcccgttaagttaaaccgtttttaacgtttacggttcggggtttacgacccggttaaacccggggttgggaacgttacggaaacttcgttacccgtaggtaaacgggttccgggggttaaccgggttcggggttcgggggacgggacgggtaaccggnggttccgttcgacccgtaacgtagtccgacgtccggacgtccgttcccgtccccgg

SEQ ID NO: 411368 - DNA, 607 bp, Homo sapiens
  misc_feature: GZ8MTXP01EIXPA.17.28.C06.1.454.CMB.2.raw
  modified_base (244)..(244): a, c, t, g, unknown or other
  modified_base (280)..(280): a, c, t, g, unknown or other
  modified_base (422)..(422): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagccgtgggggtcccngagactctcctgtgcagccctccggattcccccttnagtagttatggatgacttgggtccgccagactccgaggggaaggggctgggaggtgggtgaccaacagtaaagcaagataggaactggtacccgtaggttttacgtggactcgtagtgaagggtcctttcaccatctcaganacacgacaagatcatagtatcacactgaacagcctgggaacgtagtcgacagaccgacggtcgttagtattcgtgtcgcggaagtgttagggtaaaggttaaaagtagttagggttcgttgggttaggttttaaggttcgggggaaccgagggggaccttcccgggttgggttcccctaacccgg

SEQ ID NO: 411369 - DNA, 611 bp, Homo sapiens
  misc_feature: GZ8MTXP01E1ZM9.17.28.C06.1.454.CMB.2.raw
  modified_base (192)..(192): a, c, t, g, unknown or other
  modified_base (355)..(355): a, c, t, g, unknown or other
  modified_base (380)..(380): a, c, t, g, unknown or other
  modified_base (458)..(458): a, c, t, g, unknown or other
  modified_base (466)..(466): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtntgaggtccagttgtgagtccggggagcctggtccagccgtggggggtccctgagactctcctgtgcagccctccggattccccttcagtagttatggatgacttgggtccgccagactccgaggggaagggggctggagtgggtggccaacataaagcaaganggaactgcccccgtaggttttacgnggtactctaggtgaagggtccgtttacaccatctccagagacaacgccaaagattcactgtatctacgaactgaacancctggganagtcgcagtaccgacggcccgtgtacttactggtcgcggaagtattaggtaaagggaaaaaagttaagtgggacgttggttggtttttaaggtcggggggaacccctagggggaccttcccccggttggttccccgtaaccccgg

SEQ ID NO: 411370 - DNA, 640 bp, Homo sapiens
  misc_feature: GZ8MTXP01BN78B.17.28.C06.1.454.CMB.2.raw
  modified_base (279)..(279): a, c, t, g, unknown or other
  modified_base (303)..(303): a, c, t, g, unknown or other
  modified_base (377)..(377): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggagcctgatccagccgtgggggtccctgagctctcctgtgcacgcctccggacttcccctnagtagtatggatgacttgggtccnccagactccgaggggaagggctggagtgggtggaccaacgataaagcaagatggaactcgccgtagttttacgngtactcgtgtggaacgggtccgtttcacctatctaccgagacaacaaccgaccaaagtaacttccaacttgttaactacctaacaactacgaaacacgccgtaggaggtacgtcgacgacggaccgacgggtcccgttagttattacgtggtgaacgtagagtagggttaaaggaaaaagttgttcgggttctttgggttaacggttttagggtcgggggtacccgtagggggacccgtcccggttaacggggttaacccccg

SEQ ID NO: 411371 - DNA, 645 bp, Homo sapiens
  misc_feature: GZ8MTXP01D6FHI.17.28.C06.1.454.CMB.2.raw
  modified_base (237)..(237): a, c, t, g, unknown or other
  modified_base (245)..(245): a, c, t, g, unknown or other
  modified_base (393)..(393): a, c, t, g, unknown or other
  modified_base (428)..(428): a, c, t, g, unknown or other
  modified_base (462)..(462): a, c, t, g, unknown or other
  modified_base (468)..(468): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtcgtcgggacccccggcaggaggtcacatatcttgtctagaaacngctccggnatctacaaactaaactattttgctaggtaccagcaaacttcccgaaggactccccggccccccgactccctacatactaataagaaatgatcaagtcccggccctccgacgggtcccctaggaccctattcgtctggtacccttcctntcgtctccggcctaccctcgacgtcccctccctanaccatcgagtcgggcctccgggtaccgagggtanggagtntagttaatttaacttacgtggtacgaccgtaccgggtggtactacgactacgtaccgtaggtaacggttcggggttccgggttcggggtcgggaccggggacgggtaacccgagggttccgttaacggtaacccgttacgtaacggtccaccggacccgtaacgggttccctcccgg

SEQ ID NO: 411372 - DNA, 629 bp, Homo sapiens
  misc_feature: GZ8MTXP01CC180.17.28.C06.1.454.CMB.2.raw
  modified_base (400)..(400): a, c, t, g, unknown or other
  modified_base (537)..(537): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgctgttttagaaggtgtccagtgtgaggtccagttggttgaggtccgggggaggcctggtccagccgtgggggtccctgagactctcctgtgcacgccctccggtacttccccttgagttagttagtggatgtacgttgggtccgcagactcggaggggaggggctgggaggtgggcggaccaagaataaacggcaaggagtaggaactgaccccgttaggtttttacgnggtacttgtagggtaggtaacgggtcctttacaccgtatcctacgagacacaacgacctaagactcattagtactactaacaacgtgaaacacgccgtagggagacgtcgacgagtacgacggcgttagtattacgngtgacgtaatagttggtaaaggttaaaagtatgggttacgttggttagtttaagggtcggggaacgaggggacgttcccgtggcctaaccgg

SEQ ID NO: 411373 - DNA, 638 bp, Homo sapiens
  misc_feature: GZ8MTXP01DTTTO.17.28.C06.1.454.CMB.2.raw
  modified_base (239)..(239): a, c, t, g, unknown or other
  modified_base (246)..(246): a, c, t, g, unknown or other
  modified_base (261)..(261): a, c, t, g, unknown or other
  modified_base (438)..(438): a, c, t, g, unknown or other
  modified_base (443)..(443): a, c, t, g, unknown or other
  modified_base (482)..(482): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcaggtcctgggcccagtctgtgctgactcagcccaccctcagtgtccgtcgggacccccggcaggaggtcaccatatcttgtctaggaaacngctccgnatctacaaactaatnttttgctggtaccagactaacttcccgaggtactcccggccccccatccctcatacctaataagaaatgactcacgtcccggtccccgttccgggggtccctcgaaccccgtactttccgtcgtcggtacctcccagttcgtcgtcgccctaccctcacgtccctcccagtaccctntacgnggttcgggcccgttcccgggacgtaaggtgtagaccggnttagtacttttacgttacgtcggttcgaccgttacggtagggtacttgaaactcgtacgtaggtcggttcgggtccgggttggttacgggcgggacgacgcggttcgttccggttacctcgtaagcgacccgacgttcgtccttcccggtaacccg

SEQ ID NO: 411374 - DNA, 614 bp, Homo sapiens
  misc_feature: GZ8MTXP01BJNOF.17.28.C06.1.454.CMB.2.raw
  modified_base (471)..(471): a, c, t, g, unknown or other
  modified_base (586)..(586): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgactgggttttccttgttgctgtttagaaggtgtccagtgtgaggtccagttggtgaggtccggggaggcctggtccagccgtgggggtccctgagactctcctgtgcagcctccggacttccccttcagtagttattggatgacttgggtccgccagacctccgaggggaaggggctgggaggtgggggtggaccaaacataaagcaaggataggaactggccgtagtttacgtggactctggtagaacgggtccgttcacctatctccagacgacaacgcaaagtatcaatatactactaacgaactgaacagcctaggacgngtcgacagacgaccggtccgttagtacttacgtggtcgcggaagtgttaagggttaaagggtaaaaattaggtgggtcttagggtttggtttaggttcgggggctaagggggacncccggttcgggtaaccttcccggttccc

SEQ ID NO: 411375 - DNA, 642 bp, Homo sapiens
  misc_feature: GZ8MTXP01BDRLG.17.28.C06.1.454.CMB.2.raw
  modified_base (217)..(217): a, c, t, g, unknown or other
  modified_base (272)..(272): a, c, t, g, unknown or other
  modified_base (380)..(380): a, c, t, g, unknown or other
  modified_base (419)..(419): a, c, t, g, unknown or other
  modified_base (545)..(545): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggngctggtcagccgtgggggtcctgagactctctgtgcagcctccggattccccttnagttagttatggatgtacgttgggtcccgcagactccgagggggaggggctgggagtggggtgaccaaacagtaaagcaaagataggaactgccccgtagttttacgnggtactcgtaggtaggaacgggtcccgtttacaaccctntcctaccgagtaacgaacaaccgaccaaagtacttccaactagtactactaacaactagaaacagtcctggggaacgtcggtccgacgaaacggaccgaccggggtccgttaggttactttaccgngtaggcgtaagtagttaagggtaaacggaaaaagttagtggttagtttgttaggtttaaggtcggggcgtaggggcgttcccgtggttcctaacccg

SEQ ID NO: 411376 - DNA, 681 bp, Homo sapiens
  misc_feature: GZ8MTXP01DLU5S.17.28.C06.1.454.CMB.2.raw
  modified_base (281)..(281): a, c, t, g, unknown or other
  modified_base (352)..(352): a, c, t, g, unknown or other
  modified_base (592)..(592): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgttttagaaggtgtcagtgtgaggtcagttggtgaggtcggggagcctggtccagccgtgggggtccctgagactctccgtgtgcacgccctccggtacttcccctntagtattatggatgtacgttcggccgacagacgtcgaaggggaggggcgtgggaggtgggtacgaccaaanaagtaaaagcaaagtagtaggaacgtcgtaccccgttaaggttttacgtggtaacttcgtaagtacgggtaacggggttccctttaaccaaccgtactccgtaccgaagaacgaacccaaacgacctaaagtaacttaccgtaattacgttaactacgttaaaccaaacgtacgaaactacgaccgtagggaagtacgtacgacgacgaaccgtcggtaccgttagttactacgtgacgngaagtagttaggtaaagaaaagttagtggttcgttggttaggtttaaggtcgggaaccgagggtaccgttccgttcggttcctaacccg

SEQ ID NO: 411377 - DNA, 657 bp, Homo sapiens
  misc_feature: GZ8MTXP01A949F.17.28.C06.1.454.CMB.2.raw
  modified_base (297)..(297): a, c, t, g, unknown or other
  modified_base (326)..(326): a, c, t, g, unknown or other
  modified_base (372)..(372): a, c, t, g, unknown or other
  modified_base (597)..(597): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtcagtgtgaggtcagttggttgaggtcggggagctggtccagccgtgggggtcctgagactctctgtgcagcctccggattccccttcagtagttatggatgacttgggtccncagactcgaggggaggggctggagtgggnggcaacataaagcaaagatggaaactggaccccgtagttttacggnggtactcgtagggtaggaacggggtcccttttacaaccgtatccgtaccgaagacgaacaaacggaccaaagtaacttacacttagttactaccttaacaaacttgaaacctaggtcccgtaggggaaggtacggtaccgacgaacggaccgaaccggtccgttaggttaacttaaccgtgtacggcgtaagagttagggtaaacggaaaaagttagtcgggttnttggttacgttttaaggtcgggggccgtaaggggcgttcccgttgggttccctaacccgg

SEQ ID NO: 411378 - DNA, 865 bp, Homo sapiens
  misc_feature: GZ8MTXP01A19MS.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttgtgagtcggggagctggtccagcgtggggtcctgagctctctgtgcagcctccggacttccccttctagtattagtggatgtacgttcgggtccgcacgactccggaaggggaaggggctggggaggtcgggggtcggacccaaactaagtaaaacggcaaaggaagtacgggaaacgtcggtaccccggttaaggtttttacggcgggtaccttcggttaagggtacgggtaaccggggttcccgtttacccgaacccgtacttacccgtaccgaagggaaaccgaaaccaaacccggaaccctaaaaggtaaactttaccgtaaacttacggttaacttaacctttaaaccgaaacgttaacgaaaaccgtacgtaacccgttaagggggaacggtaaccggttaccgaccggtaaacggaacccggtaaccgggttaccccgttaagggttttaaactttaacccgggtttcggtaaggtaaccgggaagtttaaacggttaacggggtttaaaaaaggggttaaaaaaagttaaccgggttggggtttaaccgttttggggtttaaccgggttttttaaggggttacccggggggaaccgggtaacgggggtacccggttacccccggtttcgggggttaacccctttaacccccggg

SEQ ID NO: 411379 - DNA, 578 bp, Homo sapiens
  misc_feature: GZ8MTXP01BJW7M.17.28.C06.1.454.CMB.2.raw
  modified_base (278)..(278): a, c, t, g, unknown or other
  modified_base (303)..(303): a, c, t, g, unknown or other
  modified_base (399)..(399): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagccgtgggggtccctgagactctcctgtgcagccctccggattcccctnagtagttatggatgacttgggtccncagctccgagggaggggctggagtgggtcgacaacataaagcaagatggaactgccccgtagttttacggactctgtgaagggtccttcaccatcncagacacaacgccaagattcatagtatctaacaactagaacagccctagggagtagtcgacagaccgacggccgtagtacttacgtgtcgcgaagtattggtaaggaaaagtagtggttcgttggttagtttaagggttcggggccgtaaggggcgttcccgtggttcccgtaacccgg

SEQ ID NO: 411380 - DNA, 729 bp, Homo sapiens
  misc_feature: GZ8MTXP01BDRXL.17.28.C06.1.454.CMB.2.raw
  modified_base (210)..(210): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtcgtcgggacccccgggnaggagggtccacctattatcttgttctaggaaacagcctccggcatctacaaacttaaactattttgctacggtaccagacctaaacttcccgaggacctccccgggccccccactccctctatctaataagaaatgactcacgtcccggccccgttccggggtccctcggtacccccgtactttcgtcgtcggtccctaacccgtagttcgttcccgtcgggaccctaaccccgttccacccggtccccttaccccgtacgtaccctaacgtccggtacggggttccggggtcccgtttaccccggggtaccggaacgggtacgttagggaacgtccgttaggttaacttttaacgttaacgtttcggcggaccggtaccggttaaggctacggactacgtccgtaggtaacgttccggggtcggttgggttccggggacgggttacgggaacgtcggggcgttccggacccgttctaaacggccgacggcccgaacggtcccgttcccggtcccccg

SEQ ID NO: 411381 - DNA, 564 bp, Homo sapiens
  misc_feature: GZ8MTXP01AYTVT.17.28.C06.1.454.CMB.2.raw
  modified_base (207)..(207): a, c, t, g, unknown or other
  modified_base (237)..(237): a, c, t, g, unknown or other
  modified_base (244)..(244): a, c, t, g, unknown or other
  modified_base (249)..(249): a, c, t, g, unknown or other
  modified_base (258)..(258): a, c, t, g, unknown or other
  modified_base (295)..(295): a, c, t, g, unknown or other
  modified_base (400)..(400): a, c, t, g, unknown or other
  modified_base (453)..(453): a, c, t, g, unknown or other
  modified_base (519)..(519): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggnagaggtcaccatatcttgttctaggaaacngctccgnatctnaactaactnttttgctgacagcaatccagctccggcccccatcctnatctataagaaatgactcacgtccggccccgtccggggtccctggacccccgtattctcgtcgcctacccagttcgtcgtcggcctaccctcgacgtccttcccngacatcgaggttcggcttccgggcgaaggcgtagagtctagtacttgttacgngtagccgtacggtggactggacacgtctaggtacgtcggttccggtgggttcggcgggaggaccgnggcgttcgaccgtcctagtccgcgaccaggtccgttccgtccccg

SEQ ID NO: 411382 - DNA, 686 bp, Homo sapiens
  misc_feature: GZ8MTXP01BSJD9.17.28.C06.1.454.CMB.2.raw
  modified_base (399)..(399): a, c, t, g, unknown or other
  modified_base (445)..(445): a, c, t, g, unknown or other
  modified_base (583)..(583): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggagcctggtccagccgtggggggtccctgagactctcctgtgcagccctccggacttcccccttcagttattatggatgtacttgggcccgcagacctccgaggggaacggggctgggagtgggggtaggaccaaagaataaaagcaaaggataggaactcggccccgtaggttttacgnggtactcgtaggttggaacggggtcccgtttaccacccgtattccnccgaaaggtacgaaccaaaccgacccaaagtaacttacaacttagtaacttacctaacaaactacggaaaccagacccgtgggaacggaggtaccgacaacggaaccgacgggtccggtagttactttacgtggtcgngaagtagttagggtaaaggttaaaaagtacgtgggttgtttggtttaggtttaagggttcgggggccgagggggtcgttccccggttggttccccgtaacccg

SEQ ID NO: 411383 - DNA, 663 bp, Homo sapiens
  misc_feature: GZ8MTXP01APFIA.17.28.C06.1.454.CMB.2.raw
  modified_base (282)..(282): a, c, t, g, unknown or other
  modified_base (338)..(338): a, c, t, g, unknown or other
  modified_base (343)..(343): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggaggcctggtccagccgtggggggtccctgagactctcctgtgcagcctccggacttccccttnagtagttatggatgacttgggtccgcagactccgaggggaaggggctggagtgggngcaanataaagcaagatggaactgaccccgtaggtttagtggactcgtagtaggaacgggtcctttaccaccgtactcctccaagacaaccaacgacccaaaagtaactttccattacggttaactaccttaaacaaaccgttaggaaaaccacgtaccgaggggagtacgtccgacgaacgaccggtaccggtcgttagttactgtcgtagagaagtaagttaaggtaaaggttaaaagttacggtggttacgtttggtttaggtttaacgggtacggggtaaccggtacggggtaccgttacccggttcggttaacccgtccg

SEQ ID NO: 411384 - DNA, 640 bp, Homo sapiens
  misc_feature: GZ8MTXP01C2KLL.17.28.C06.1.454.CMB.2.raw
  modified_base (349)..(349): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgcttgttttagaaggtgtccagtgtgaggtccagttggttgaggtccgggggaggcctggtccagccgtgggggtccctgagactctcctgtgcacgcctccggacttccccttctagtagttatggatgacgtggtccgcagactccgaaggggaggggctgggagtgggtggaccaanaataaagcaaagataggaactcgacccgtagtttacgtgtactcgtagtacgaacggtccgtttacaacctactcctacgaagacgaacaacgaccaaagtacttacactagtactactaacaactagaacagacctggagtacgtcacgagacgacggcgttagtatacgtgcgcgaagtagttagggtaaaggaaaaaggttagtcgggttagtttggttaggttttaacgggttacggggaaccggttaaggggaccgttcccggttaacggttcccgttaaccccgg

SEQ ID NO: 411385 - DNA, 612 bp, Homo sapiens
  misc_feature: GZ8MTXP01AB9W5.17.28.C06.1.454.CMB.2.raw
  modified_base (272)..(272): a, c, t, g, unknown or other
  modified_base (297)..(297): a, c, t, g, unknown or other
  modified_base (318)..(318): a, c, t, g, unknown or other
  modified_base (363)..(363): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaacttgggttttccttgttgcttgttttagaaggtgtcagtgtgaggtcagttggtgaggtcggggagcctggtccagccgtgggggtcctgagctctctgtgcagcctccggtacttccccttnagttagttatggatgacttgggccncagctccgagggagggctggngtgggtgacaacataaagcaagatggaactgccgtagttttacgngtactcgtggtagaacgggtccctttcgaaccctatcctaccgagacgaaccaaccgaccaaagtaacttcacttagtaactacctaacaactagaacacgaccgtagacgggacgtcgacacggacacggcgtagttacttacgtgtgacgagtaatacggttaaggtaaaaagttagtggtcttggttaggttttacggttggggccgtaaggggaccgtcccgttgggtcccgaaccggtttcccg

SEQ ID NO: 411386 - DNA, 733 bp, Homo sapiens
  misc_feature: GZ8MTXP01DJCTO.17.28.C06.1.454.CMB.2.raw
  modified_base (259)..(259): a, c, t, g, unknown or other
  modified_base (410)..(410): a, c, t, g, unknown or other
  modified_base (648)..(648): a, c, t, g, unknown or other
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggagcctggtccagcgtcgggggtcctgagactctcctgtncagccctccggacttccccttcagttagttatggatgacgttgggtcccgccagactccggaaggggacggggtcgtgggaggtggggtcggaccaacgaagtaaagcgtaaagagtacggaactcggtaccccggttaaggttttacggnggtactcgtagggtacggtaacggggtccctttaccgactactcctacagacgactaacgacctaaagtaacttcaacttagtaacttactaaacgaaactagaaacacgacccgtaggggaaacgcggtaaccggacgaaacggaccgacccgggggtacgtttacgttaaacgtttaccgtgggtacggcggtaaaggttaggttaaagggttaaaaggggaaaaaacgtttaagngggttcgtttagggttttaggttttaagggtcgggggtaaccgaagggggtcccttacccgggttcggttaacccgttaaccccg

SEQ ID NO: 411387 - DNA, 696 bp, Homo sapiens
  misc_feature: GZ8MTXP01AXT11.17.28.C06.1.454.CMB.2.raw
  modified_base (210)..(210): a, c, t, g, unknown or other
  modified_base (240)..(240): a, c, t, g, unknown or other
  modified_base (247)..(247): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcacgcccaccctcagtgtcgtcggggaccccggnaggagggtcaccatatcttgtctagaaacngctccgnatcacaaactaactattttgctgtacagactaacttcccgaggactcccggcccccctactccctacatctaataagaaatgatcgtacgtccggtccccgtccggggtccctacgaccccgtattctcgtcgcctacatcgtctcggcctacccgtcacgtccctccctacgacctacgtcgtacggtcgggccgtcccgggtacgaggtacgtggacggtcttagtaactttacgggttaacgttcggtacgtacccggtaaccggttggggaacttacgggtaacctacgttccggtaaggtaacgggttcggggttaacccgggttcggggttacgggggaccggaacgggggtaccgtaacgggttccgttacggaccccggtttaacccgaaacggtcccgacccgggtaccccgaagggtccccgttccccggtccccccgg

SEQ ID NO: 411388 - DNA, 574 bp, Homo sapiens
  misc_feature: GZ8MTXP01EWCPU.17.28.C06.1.454.CMB.2.raw
  modified_base (277)..(277): a, c, t, g, unknown or other
  modified_base (302)..(302): a, c, t, g, unknown or other
  modified_base (497)..(497): a, c, t, g, unknown or other
  modified_base (502)..(502): a, c, t, g, unknown or other
  modified_base (518)..(518): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagccgtgggggtccctgagactctcctgtgcagcctccggattcccctnagtagttatggatgacttgggtccnccagactccgaggggaaggggctgggagtgggtgaccaacataaagcaagatggaactgccccgtaggttttacgggactctaggtagaacgggtcctttcaccatcctaccagacgacaacgccaagattcatgtatcaacaactgaacagcctagggagtagtcgacaagaccgacggctagtattactgtgngaagnttggtaaggaaaagtntggcttggttgtttaagtcgggggcctaggggacgttcccgtgggttcctaacccg

SEQ ID NO: 411389 - DNA, 699 bp, Homo sapiens
  misc_feature: GZ8MTXP01CYHPB.17.28.C06.1.454.CMB.2.raw
  modified_base (382)..(382): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcttgttgctgttttagaggtgtcagtgtgaggtcagtggttgagtcggggagctggtcagcgtgggggtccctgagactctcctgtgcagcctccggacttccccttcagttagttagtggatgtacgttgggtcccgcagactccgaggggaaggggctgggaggtggggtgaccaacaataaagacaaagataggactgaccccgttaggttttacgnggtactcgtaggttaggtaacggggtcccttttacgacctatcctaccaagaacgaaccaaacgaccaaagtaaacttcaacgttagttaaactaccttaaaccaaaccgtagaaacctacggtaccctaggggaacggacgttccgaccgaacggaccgaccgggtccgttagttacttaaccgtggtcggacggtaagtaagttaggggtaaaggttaaaaaacgttaaggtgggttacgtttgggtttaggttttaacgggtcgggggaaccgtagggggaccgttccccggttcggggttccctaaccccggg

SEQ ID NO: 411390 - DNA, 590 bp, Homo sapiens
  misc_feature: GZ8MTXP01C42QW.17.28.C06.1.454.CMB.2.raw
  modified_base (278)..(278): a, c, t, g, unknown or other
  modified_base (304)..(304): a, c, t, g, unknown or other
  modified_base (344)..(344): a, c, t, g, unknown or other
  modified_base (379)..(379): a, c, t, g, unknown or other
  modified_base (519)..(519): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgagtccagttggttgaggtccggggagcctggtccagcgtgggggtccctgagactctcctgtgcagccctccggattccccttnagttagttatggatgacttgggtccnccagactccgaggggaggggctgggagtgggtggaccaanataaagcaagatggaactgccccgtagttttacgngtactcgtaggtgaacggggtcctttacacctatcctaccagacgacaacgaccaaagtaattcaactagtactactaacaactcgaacagcctagggagacgtcgcagccacggtccgtagtattacgtgtgcgaagtnttaggtaacggaaaagtagtggttagttgttaggtttaaggtcggggctagggcgttccgtcggcgtcccg

SEQ ID NO: 411391 - DNA, 695 bp, Homo sapiens
  misc_feature: GZ8MTXP01BJZJS.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtcggggaggcctggtccagccgtgggggtccctgagactctcctgtgcagccctccggacttccccttacagtagttatggatgacgttcggtccgccagacctccgaggggaggggcgtgggaggtggggtacggaccaaacgaagtaaacgacgaaagagtagggaactcggtaccccgttaggttttacggtggtactccgtaagtacggtaacgggtccctttacgacccgtactccgtaccagtaacgacctaaaccgacccgaaagtacttacgacttagtaacttacctaacgaaacttacgaaactagccctaggggaacgtacgtaccgacgaacgaccgtacggccgttgttattaccgtgtcgaggaagtaagttagggtaaaggttaaaagttaacgtggttgtttggtttacgttttaagggtcggggttccggaaggggtccgttacccgttcggttcccgtaaccccg

SEQ ID NO: 411392 - DNA, 680 bp, Homo sapiens
  misc_feature: GZ8MTXP01AVRNN.17.28.C06.1.454.CMB.2.raw
  modified_base (275)..(275): a, c, t, g, unknown or other
  modified_base (347)..(347): a, c, t, g, unknown or other
  modified_base (390)..(390): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttgtgagtcggggagcctggtccagccgtgggggtccctgagactctcctgtgcagcctccggacttccccttnagttagttatggatgtacgttgggtccgaccagactccgaaggggaggggctgggagtggggtagacccaanaataaagcaaagagtaggaaactgaccccgtaggttttacggngtactcgtagtacggtaacggtccttacacctactcctacgaagacgaccaaacgaccaaagtacttacaacttagtaactacctaacaacgtacgaaacgtacgtaccgtaggggaacggacgtccgaccgaacggaccgtaccgggtacgttagttacgttacgtggtacggacggtaagtaagttaagggtaaaaggttaaaaacggttagtcgggttagtttggtttaggtttaacggggcggggtaaccgaggggtcccgttcccggttcggttcccgtaacccg

SEQ ID NO: 411393 - DNA, 675 bp, Homo sapiens
  misc_feature: GZ8MTXP01BBKUM.17.28.C06.1.454.CMB.2.raw
  modified_base (279)..(279): a, c, t, g, unknown or other
  modified_base (307)..(307): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaacttgggttttccttgttgcttgttttagaggtgtcagtgtgaggtccaggttggtgaggtccggggagcctggtccagccggtgggggtccctgagtctctctgtgcacgtcctccggtacttcccctanagttagttatggatgtacgttgggtccnctagctccgaggggagggctggagtgggacggaccaaacgaataaacgacaaaggagtacggaaactggtacccggttaggttttacggagggtacctcgtaggtaagggaaccgggtcccgtttacaccctatccgtaccgaagacgaaaccaacgaccaaagtacttcgactgtaactactaacactagaacacgccgtagacgggtacgtacgcaacgaccgtacggtccgttagtttataccgtgtagacgaaggtaagtaaggttaaagggtaaaacgttgttaggtagtttaggtttggtttacggttaaccgggggaccgtaagggggtccctcccggttcggtcccgttaacccttcccg

SEQ ID NO: 411394 - DNA, 550 bp, Homo sapiens
  misc_feature: GZ8MTXP01B3LFU.17.28.C06.1.454.CMB.2.raw
  modified_base (278)..(278): a, c, t, g, unknown or other
  modified_base (303)..(303): a, c, t, g, unknown or other
  modified_base (352)..(352): a, c, t, g, unknown or other
  modified_base (377)..(377): a, c, t, g, unknown or other
  modified_base (452)..(452): a, c, t, g, unknown or other
  modified_base (485)..(485): a, c, t, g, unknown or other
  modified_base (530)..(530): a, c, t, g, unknown or other
  modified_base (537)..(537): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggttttcctgttgctgttttagaaggtgtccagtgtgaggtccagttggttgagtccggggagcctggtccagccgtgggggtccctgagactctcctgtgcagccctccggattcccccttnagtagttatggatgacttgggtccncagactccgagggaggggctgggagtggtggaccaacataaagcaaagntggaactgaccccgtagttttacgnggactcgtgtagaagggtccgtttcacctatcctccagacgacaacgccaagattcatagtatacacactgaacngcctggagagtcgcagcacggctagtatcctgngcaagattggaagaaagtatggacgttgttgtttaagtggggccngggtacnccgttggctcccg

SEQ ID NO: 411395 - DNA, 656 bp, Homo sapiens
  misc_feature: GZ8MTXP01DG1YV.17.28.C06.1.454.CMB.2.raw
  modified_base (188)..(188): a, c, t, g, unknown or other
  modified_base (208)..(208): a, c, t, g, unknown or other
  modified_base (227)..(227): a, c, t, g, unknown or other
  modified_base (235)..(235): a, c, t, g, unknown or other
  modified_base (244)..(244): a, c, t, g, unknown or other
  modified_base (412)..(412): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcgagggtcctgggcccagtctgtgctgactcagccaccctnagtgtcgtcgggaccccggnagaggtcacatatcttgtntagaaacngtctccganactctacaaacttaaactattttcgactacggtaccagtacctaacttcccgaaggtaccgtccccggaccccccgtactcctactaatacctaagtaacaaatgtactcacgtcccggtccccggttccgggtcctacgtaccccgtacttctcgtcgtctaacccngttcgtcgacggaccctacctccgtaccgtccctcccgtacgactacgtcgtacggtcgggtccgtaccggtcgagtcgtaggcgtacgtataagttatacgtgacgtacgacgtggactagtaccgtactccgtagtacgggttccggtcgggtcggttacgggacgggacgtaccgtggttccgttcgacccgtaagtaaacgtcgaaccgggcccaacggtccccgttaaccgtcccccgg

SEQ ID NO: 411396 - DNA, 734 bp, Homo sapiens
  misc_feature: GZ8MTXP01D23U2.17.28.C06.1.454.CMB.2.raw
  modified_base (272)..(272): a, c, t, g, unknown or other
  modified_base (359)..(359): a, c, t, g, unknown or other
  modified_base (593)..(593): a, c, t, g, unknown or other
tcagcgtagactagcacgaccggtgctcgatttagagctcacgtattgggtttggggaggtctcagagaggaggcttagccctggactccaaggccttttccacttggtgatcagcactgagcacagaggactcaccatggagttggggctgaactgggttttccttgttgctgttttagaaggtgtcagtgtgagtcagttggtgaggtcggggagctggtcagccgtgggggtcctgagctctctgtgcagccctccggacttccccttnagttagttatggatgtacgttcgggtccgcctagacgtaccggaagggggaagggggctaggggaggttgggggtacggacccaaanaataaaagcaaagagtaggaaacttcggaccccgttaaggttttacgaggtaccttgtagggtagaacgggggtcctttcgaacctatccaccgaagacgaacaaacgaccaaagtaacttcacttagtactactaacaacgtagaacgaacgtccgtaggggaagtacggggtaccacgaaacggtaacccgacggggtcccgtttaggttaaactttaccggtaggttcggnggtaaaggttaagttagggttaaaagggttaaaaaagttaagggttccgggttacgtttagggtttacgggtttttaagggttacggggggtaaccgtaacgggggcgttcccccggtttaagggttccccgttaaccccg

SEQ ID NO: 411397 - DNA, 753 bp, Homo sapiens
  misc_feature: GZ8MTXP01AB855.17.28.C06.1.454.CMB.2.raw
  modified_base (335)..(335): a, c, t, g, unknown or other
  modified_base (371)..(371): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagctggtccagccgtgggggtccctgagactctctgtgcagcctccggattccccttcagtagttatggatgacttggtccgcagactccgagggaggggctggagtgggtgccaanataaagcaagataggaactgccccgtagttttacgnggactcgtaggtaggaacgggtccgtttacaccgtacttccgtacccaagaacgaaccaaaccggacccaaaaggtaaactttccaacgttacggttaaacttaccttaaaccaaaaccgttacggaaaaccgtaacggccccgttagggggaacggtaacggttccgaccgaaggaacccgaaaccggggtcccgtttaggttaaacctttaaccgtgggttacgccggtaaaggtaagtttacggggtaaaaggggaaaaaaaacgtttaaggttggggttccgttttagggtttagggtttttaaacgggtttcggggggaaccccgtaaggggggtacccgttccccggtttaacggggttccccgtttaacccccgg

SEQ ID NO: 411398 - DNA, 647 bp, Homo sapiens
  misc_feature: GZ8MTXP01D7FTL.17.28.C06.1.454.CMB.2.raw
  modified_base (284)..(284): a, c, t, g, unknown or other
  modified_base (356)..(356): a, c, t, g, unknown or other
  modified_base (397)..(397): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggaggcctggtccagccgtgggggtccctgacgactctcctgtgcagccctccggacttcccccttnagttagttatggatgtacgttgggtccgccagaccgtccgaaggggaggggctgggaggtgggtgaccaaanaagtaaagacgaaagatggaactgtacccgtagttttacgnggtactcgtaggtaggaacggggtcctttccgaccctatccgtcaagacgacaacgaccaaagtaattcacttagtactactaacaactagaacagcctgggaacgtagtcgacgagaccgacggtacgtacgtagttactaggtgtacgaagtagttaggaaaggttaaaaagtagtcggttcgttggtttcgtttaagggttcggggaacccgtaggggaccgttcccggttcgttcccgttaacccg

SEQ ID NO: 411399 - DNA, 567 bp, Homo sapiens
  misc_feature: GZ8MTXP01ECL36.17.28.C06.1.454.CMB.2.raw
  modified_base (298)..(298): a, c, t, g, unknown or other
  modified_base (371)..(371): a, c, t, g, unknown or other
  modified_base (377)..(377): a, c, t, g, unknown or other
  modified_base (395)..(395): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagcctggtcagccgtgggggtcctgagactctcctgtgcagcctccggattccccttcagttagttattggatgacttgggtccncagactccgaggggaaggggctggagtgggtggaccaaacataaagcaagatggaactgccgtagttttacgnggactntgtagaacgggtcctttnacccatctccagagacaacgcaaagatcactgtatctaacactgaacagcctgaggagtcgacagacacggccgtgtacttactgtgcgagaatgttaagggaaaagttagtggtcttggttgtttaagtcgggggaccaaggggtacgcccgttgggtccaacccggttcc

SEQ ID NO: 411400 - DNA, 607 bp, Homo sapiens
  misc_feature: GZ8MTXP01A3678.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtggggggtccctgagactctcctgtgcagccctccggacttccccttcagtagttatggatgacttgggccgcagactccgagggaaggggctggagtgggtggaccaacataaagcaagataggaactgacccgtagtttacgtgactcgtgtggaacgggtcctttacaccatcctacgagacgaccaacgccaaagattcaacttgtactctaacaactgaaacagtcctgggacgacgtcgacgacggaccacgggccgttagtacttacgtgtgcgaagtagttaggtaaaggaaaagtagtggttacgttggttaggtttaaggtcgggggaactaggggacgttcccgtgggttccctaacccg

SEQ ID NO: 411401 - DNA, 661 bp, Homo sapiens
  misc_feature: GZ8MTXP01A0LYL.17.28.C06.1.454.CMB.2.raw
  modified_base (391)..(391): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagccgtgggggtccctgagactctcctgtgcagcctccggacttccccttcagttagttatggatgacgttgggtccgccagactccgaggggacggggctgggaggtgggtacggaccaaacgaataaagcaaagataggaactgaccccgtagttttacgnggactcgtaggtggtaacgggtcccgtttacacccgtatcctaccgagacgacctaacgaccaaagtaacttacgacttaggtacttacctaacaaccttagaaacacgccctaggggaaggtacgtcgacaggaaccgaccggtccgttaggttacttacgtggtacgcggaagtagttacggtaaaggaaaaagttaggtggttagttggtttaggtttaagggtcggggaaccgaagggggcgttcccggttggttcccgtaacccg

SEQ ID NO: 411402 - DNA, 778 bp, Homo sapiens
  misc_feature: GZ8MTXP01CS1QD.17.28.C06.1.454.CMB.2.raw
  modified_base (658)..(658): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgctgttttagaaggtgtccagtgtgaggtccagttggttgaggtccggggagcctggtccagccgtgggggtccctgacgtactctcctgtcgcacgcccgtccggtactttcccccttcgagttagttatcggaattcggtacgttcgggtcccgccgaaggtaccttacccggaggggaaagggggccgttaggggagggttacgggggtcggaaccccaaacgaaagttaaaaacggccaaaaggtacgttacggggaaacttcgggaccccccggttaaggtttttaccggtggtaaccttcgtaagggttaggaacggggtcccgttttacaccctagtcctaccgaagtaacgaaccgaaacgacccaaagtaacttaccaagttacgttaactacctaaacgtaaaccttagaaaccacggtaccctaggggaacgtacggtccgacgaacgaccgaccgggtccgttagttaacttacgngttacgacgtaagtagttagggtaaaggaaaaagttagtacgggttacgtttggttagggtttaaggttcgggggaaccgtaagggggtccgttcccgtaacggggttccctaaccccgg

SEQ ID NO: 411403 - DNA, 715 bp, Homo sapiens
  misc_feature: GZ8MTXP01BKP19.17.28.C06.1.454.CMB.2.raw
  modified_base (215)..(215): a, c, t, g, unknown or other
  modified_base (222)..(222): a, c, t, g, unknown or other
  modified_base (245)..(245): a, c, t, g, unknown or other
  modified_base (414)..(414): a, c, t, g, unknown or other
  modified_base (530)..(530): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgttttagaaggtgtccagtgtgagtcagttgtgagtcgggngctgtcngcgtggggtcctgagctctctgngcagcctccgtacttcccctgtagttagttatggatcgtacgttcgggtcccgccagtaccgtaccggagggggtaacggggtcgtaggggaggtggggtacggaccaaacgaaagtaaaacgacgaaagagtacggaacgtcggtacccccggttaaggttttacggnggtacctcgttaagggtacgggtaacggggttccctttaccgaccgtactcctaccgaagtaacgaccaacgaccgaaagtaacttcgactagtactactaacaacgtacgaaacncgtacctaggggacgtacggtccgacgaacggacccgaccggttccggttaagttacttacgtggtcgacgaagtaagttaagggtaaaaggttaaaagtaggtcgttacgtttggtttacggtttaacgggtacggggaacccgaaggggtcccttacccggttaacggttcccgttaaccccg

SEQ ID NO: 411404 - DNA, 665 bp, Homo sapiens
  misc_feature: GZ8MTXP01C7XI4.17.28.C06.1.454.CMB.2.raw
  modified_base (188)..(188): a, c, t, g, unknown or other
  modified_base (208)..(208): a, c, t, g, unknown or other
  modified_base (238)..(238): a, c, t, g, unknown or other
  modified_base (272)..(272): a, c, t, g, unknown or other
  modified_base (633)..(633): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcacgccaccctnagtgtcgtcgggaccccggnagaggtcacatatctgttctagaaacagcncggcatctacaaactaactatttgctaggtaccngactaacttcccgaggaaccgtcccggccccccctatcccctactacgtactaataacgaaagtcgaacttcgaccgttcccggtcccccggtacccgggtcctacgtaacccccgtgtttacctcgtcggtcctaaccgtgttcgtcgtacgactaactctcgaccgtcccaccgtacgactacgtcgaggtccggaccgtccggtacgaggtacgtgacgtacgtagttaacgtttacgtacgttcgtaccgtacggtaccggttagggacttacgaccgttagtcccgtaaggtcgttaacggggtccggttgggttcggggacggtacggacggttacgttcgaccgtcccgtaacncgaccgacggacccgtaagggcccctccccgg

SEQ ID NO: 411405 - DNA, 679 bp, Homo sapiens
  misc_feature: GZ8MTXP01A72N5.17.28.C06.1.454.CMB.2.raw
  modified_base (225)..(225): a, c, t, g, unknown or other
  modified_base (271)..(271): a, c, t, g, unknown or other
  modified_base (408)..(408): a, c, t, g, unknown or other
  modified_base (450)..(450): a, c, t, g, unknown or other
  modified_base (504)..(504): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggtgagtcggggagcctggtcngccgtgggggtcctgagctctcctgtgcacgcctccgattcccctnagtagttatggatgtacgttcgggtccgccagaccgtccgagggggaaacggggtctaggggaggtgggggtacggacccaaaacgtaagtaaaagcgaaagagtacggaaactggacccccggtagtttttacggnggtacctcgtggtaggtaacgggtccgtttaccaccattccnccaggacgacaacgaccaaagtattcatagtactactaacgaacttacgaaacncgtacctggggaagacggtccgaccgacgtaccggaccgggtccgttaggttacttacgtgtcggccgtaagtagttacgggtaaaggttaaaagtaacgtgggacgtttgggttacggttttaacggtacgggggtccgaaggggacgttcccgtcggtttaaccgtaaccccg

SEQ ID NO: 411406 - DNA, 727 bp, Homo sapiens
  misc_feature: GZ8MTXP01CMNG0.17.28.C06.1.454.CMB.2.raw
  modified_base (210)..(210): a, c, t, g, unknown or other
  modified_base (239)..(239): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcggccaccctcagtcgtcgtcggggacccccggnaggaggtcacatatcttgtctaggaaacngctccggcatctacaaactaactattttgctgtacagcaacttccgaggtcctcccggccccccgatccctactactactataagtaatgactcacgtccggtccccgttccgggtccctgtacccgtacttccgtcgtcggtctacctaacgttcgtccgtcggaccctacccgttacgccggtcccccttaccgtacgtaccctagtaccggtacgggtccggggtcccttaccgggggtaccgaaggggtctacgggaacggttctaggtttaactttagttacggggttcggaaccggtcctaaccgggggtgactagaccgttaagtccggtagggttaacgttcccgggggttccgggtgggttcccgggggacggggtaaccgggttaccgtacggggtcgttaaccgggttcccgttaacccggttaagccccggttaacgaaccccgacgggttccctccccggttaaccccgttccgg

SEQ ID NO: 411407 - DNA, 659 bp, Homo sapiens
  misc_feature: GZ8MTXP01C486J.17.28.C06.1.454.CMB.2.raw
  modified_base (260)..(260): a, c, t, g, unknown or other
  modified_base (288)..(288): a, c, t, g, unknown or other
  modified_base (342)..(342): a, c, t, g, unknown or other
  modified_base (355)..(355): a, c, t, g, unknown or other
  modified_base (383)..(383): a, c, t, g, unknown or other
tcagcgtagactagcacgaccggtgctcgatttagagctcacgtattggggtttgggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgaggtccggggagcctggtccagccgtgggggtccctgagactctcctgtncagccctccgacttcccctgagtagttntggatgtactcgggtccgcagactcgaggggagggctgggagtgggtgaccaanagtaaagcaaganaggactggtaccccgtaggttttacggngtactcgtaagggtacggtaacggttccttaccactactccacgagaacaaccaacgacaatactactaactattaactactaaccgaactacgaacgacgtactagggggaacgtacggtaccgacgaacggaccggtacggtccgttagtacgttcgtagaggaggtaagtaaggttaaacggtaaagggaaagttaggtcggttagtttggttagggtttcgggtacgggggaaccgtaacgggtccgttcccggtaacggttcccgtaaccg

SEQ ID NO: 411408 - DNA, 611 bp, Homo sapiens
  misc_feature: GZ8MTXP01DRDE9.17.28.C06.1.454.CMB.2.raw
  modified_base (250)..(250): a, c, t, g, unknown or other
  modified_base (268)..(268): a, c, t, g, unknown or other
  modified_base (293)..(293): a, c, t, g, unknown or other
  modified_base (327)..(327): a, c, t, g, unknown or other
  modified_base (361)..(361): a, c, t, g, unknown or other
  modified_base (471)..(471): a, c, t, g, unknown or other
  modified_base (516)..(516): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgagtcagttggtgaggtcggggagctggtccagcgtgggggtcctgagctctctgtncagccctcgattcccctnagtagttatggatgtacttggtccncagactccgagggagggctggagtggtgaccaanataaagcaagatggaactgcccgtagttttacgnggtactcgtagtaggaacgggtccctttacgaccctatcctacagacgacaacgacctaaagaacttcgacttagtactactaacaactacgaacagccctaggggacgngtaccgacgacgaccgtaccggtccgttagttaacttcgtgtcgnggaagtgttaggtaaaggaaaaagttgtaggttagtttgttaggtttaaggttgggggaaccgtaaggggcgttcccgtcggttccgtaaccccg

SEQ ID NO: 411409 - DNA, 685 bp, Homo sapiens
  misc_feature: GZ8MTXP01BYOI3.17.28.C06.1.454.CMB.2.raw
  modified_base (209)..(209): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtcgtcgggacccccggnaggagggtcaccattatcttgttctagaaacagctccggcattctacaaactaaactattttcgctggtaccagacaacttcccgaggactcccggccccccgactccctcactctaataagaaatgactctacgtccggtccccgtccggggtccctcggtaccccgtacttcgtcgtcggcccttacccagttcgtccgtcgggcccaccctccgaccgcccctccctcgacctacgtcgaggtccggtcgtcccgggtaccggaggtagacgagctagtactttaggttacgtggtcgacgtacggtggtactcgactgtacccgtaggtaacggtcgggtccggggttaggttcccgggggacgggaccggggtaaaccgtcgggttccgttccgggttaaccccgtaaccggttaccggtcgaacccggggacccggttaacgggtccccgttaacccggttccccccggg

SEQ ID NO: 411410 - DNA, 734 bp, Homo sapiens
  misc_feature: GZ8MTXP01CDTN2.17.28.C06.1.454.CMB.2.raw
  modified_base (355)..(355): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgctgttttagaaggtgtccagtgtgaggtccaggttggtgaggtcgggggagcctggtccagccgtgggggtccctgacgactctcctgtgcagtccctccggacttccccttcagttagttatggatgtacgtgggtccgccagacctcgaggggaaggggcgtggaggtgggtaggaccaaanaagtaaagcaaaggagtaggaactcggtacccggtagttttacggtggacttcggtagtagggtaacgggtcccttttacgaaccgtactccgtacgaaggaacgaaccgtaaaccgaacccgaaaggtaaactttaccgtaacgttacggttaacttaaccgttaacctaaaccgttacgaaacgacgtacccgttaggggaacggacggttacgacgaacggaccgtacgggtacccgttagttatacggttcgtaggtggaagtgttaaggggtaaaggaaaaaggtttagtggttacggtttggttacggttttaagggtcgggggtaaccgtacgggggtacgttaccccgggtttcggttaaccgttccccgg

SEQ ID NO: 411411 - DNA, 763 bp, Homo sapiens
  misc_feature: GZ8MTXP01BPR8S.17.28.C06.1.454.CMB.2.raw
  modified_base (290)..(290): a, c, t, g, unknown or other
  modified_base (349)..(349): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcacctcctcactcactgtgcagggtcctgggcccagtctgtgctgactcagcccaccctcagtgtctgggaccccccggagagggtcaccatatcttgttctaggaaacagcctcggcatcctacaaactaaactattttgctgtaccagacaattcccagcnccgcccccgactcctcatctataagaaatgactcacgtccgccccgttccggggtcccnggaccccctattctctcggtcctaacccctagttcgtcctcgggccctaccccgttccgaacgcccctcccgttacgacctaacttccgagggttcccggggtccttaccccggggtcccgtaagggtacggtcgtaacgggtaccttagttaaccgttttaaaggttacgtttcgggttcggacccggtaacccggggttagggtaccgtacggtaaccttaaccgttacccgggttaggtaacggtttccggggggttcccgggtttacggggtttcccgggggacgggggttaaccggggaacccgtaacggggttccccggttacgggttaccccggtttaacccgtaaacggttcccgtaacccggacccccgggttaaacggtccccgtttccccggtcccccccggg

SEQ ID NO: 411412 - DNA, 658 bp, Homo sapiens
  misc_feature: GZ8MTXP01BDVF9.17.28.C06.1.454.CMB.2.raw
  modified_base (401)..(401): a, c, t, g, unknown or other
  modified_base (492)..(492): a, c, t, g, unknown or other
tcagcgtagactagcacgaccggtgctcgatttagagctcacgtattgggtttggggctcagagaggaggcttagccctggactccaagtcctttccacttggtgatcagcactgagcacagaggactcaccatggagttggggctgaactgggttttcctgttgctgtttagaggtgtccagtgtgaggtccagttggttgaggtccggggagcctggtccagccgtgggggtccctgagctctctgtgcacgcctccggtacttccccttcgtagtagttattggatggtacgttgggtccgccagacgtccgaagggggaacggggcgtggaggtcggggtcggacccaaacaagtaaacgcaaaggatacggaacttggccgtaacggttttacggnggtacttcgtggtaacggaacgggtcccgtttcaccgtatcctaccgagacgaccaacgacaagtacttcattgtaactctaacaaacgtnaaacgcgtaccgtaggacgggacgtccgacgacgaccgaccggtccgttagttaacttcgtagtcgacgtaagaagtaggttaaaggaaaaagttgtgggtcttggttagtttacgggtcggggaccgaaggggccgtcccggttggtaacccttaaccggttccc

SEQ ID NO: 411413 - DNA, 702 bp, Homo sapiens
  misc_feature: GZ8MTXP01DHEE6.17.28.C06.1.454.CMB.2.raw
  modified_base (189)..(189): a, c, t, g, unknown or other
  modified_base (209)..(209): a, c, t, g, unknown or other
  modified_base (236)..(236): a, c, t, g, unknown or other
  modified_base (243)..(243): a, c, t, g, unknown or other
  modified_base (259)..(259): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcacgcccaccctnagtgtcgtcgggaccccggnagaggtcaccatatcttgtctgaaacngctccgnatctacaactaaactnttttgctggtaccagactaacttcccaggcctcccggccccctactcctcactctaatagaaatgatcacgtccgcccgtccgggtcctcgaccccgtattctcgtacggtcctaccatttcgtcctcggacccacccgtcaccgtccctacccctgaaccctacgtcgacggttcgggtccctacccgggtaccgaaggtacgttacggaggtaccttaggttaacttttaaacggtttacgttggggttaccgaccgtaacccggggttaggggtacttaacggtaaaccgttcgttacccggttaaggtaaacggtttcgggggttcccggttagggttccggggtacggacggggtacccgagggttcccgttcggttaaccccggttcttaagggtcccgaccggtacccgaacggtccccgttcccggttcccccgg

SEQ ID NO: 411414 - DNA, 668 bp, Homo sapiens
  misc_feature: GZ8MTXP01D85TN.17.28.C06.1.454.CMB.2.raw
  modified_base (214)..(214): a, c, t, g, unknown or other
  modified_base (245)..(245): a, c, t, g, unknown or other
  modified_base (268)..(268): a, c, t, g, unknown or other
  modified_base (314)..(314): a, c, t, g, unknown or other
  modified_base (318)..(318): a, c, t, g, unknown or other
  modified_base (388)..(388): a, c, t, g, unknown or other
  modified_base (412)..(412): a, c, t, g, unknown or other
  modified_base (418)..(418): a, c, t, g, unknown or other
  modified_base (477)..(477): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctccaccctcctcactcactgtgcagggtccgtcgggcccagtctgtgctgactcacgcccaccctcagtcgtcgtccggggaccccggnagacggtcaccatatcttgttctaggaaacncgcgtccgcatcacaactaactntttgctgacagcaactcagctcccgccccactccacatactataanaatntactcgacgtccggtcccgtccggtccctacgaccgtccttctcgtcgcctctaatcgtcgtcgcctccnccaccgtcccctccgtacaacccngtacgngggtccggtccgtcccgggtacgaggtagtacggcgattaggtattaaccttcgggggngttaaccgccgtaacggggtgtacgtacacgttaccgtacgttaaggtagtttccgggggtccgggtttcgggcgggggaccggaaccggggttaacggtacgggtccgttaccccgggttaaccttacccgtaagtacccgaacggttaccccccgaggggttcccctccccgttccccgggttaacccg

SEQ ID NO: 411415 - DNA, 733 bp, Homo sapiens
  misc_feature: GZ8MTXP01CN4W6.17.28.C06.1.454.CMB.2.raw
  modified_base (319)..(319): a, c, t, g, unknown or other
  modified_base (382)..(382): a, c, t, g, unknown or other
  modified_base (413)..(413): a, c, t, g, unknown or other
tcagcgtagactagcacgaccggtgctcgatttagagctcacgtattggggtttgggggaggtctcagagaggaggcttagccctggactccaaggcctttccacttggtgatcagcactgagcacagaggactcaccatggagttggggctgaacttgggttttccttgttgcttgttttagaaggtgtccagtgtgaggtccaggttggttggaggtccgggggaggcctggtccaggccgtggggggtccctgagctctcctgtgcacgcctccggacttccccttcagttagttatggatgtacgttcgggcccncgagaccgtccggaaggggaggggctgggaggtggggtcggacccaagaagtaaacgcaaagngtaggaaactggaccccgttaggttttacgnggtaactcgtaggtacggaacgggtcccgtttacacctactcctacgagaacgaaccgaaccgaaccaaaggtaaactttccgaaactacgttactaactaaaccaaacgttagaaacgacgtcccgttaggggagaaccggttcgaaccgtacgtacccggaccgggtccgttaagttaacgttaccgtaggttggcggtaaagtggttaaggtaaaagggaaaacgtttaggtacgggttcgttttgggttagggttttcggtacggggggtccgaacgggggtaccgttccccggtaaggttccccgtaacccccgg

SEQ ID NO: 411416 - DNA, 636 bp, Homo sapiens
  misc_feature: GZ8MTXP01B0XQI.17.28.C06.1.454.CMB.2.raw
  modified_base (274)..(274): a, c, t, g, unknown or other
  modified_base (297)..(297): a, c, t, g, unknown or other
  modified_base (334)..(334): a, c, t, g, unknown or other
  modified_base (384)..(384): a, c, t, g, unknown or other
  modified_base (529)..(529): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtccagtgtgaggtccagttggttgaggtccggggagcctggtccagccgtgggggtccctgagctctcctgtgcagcctcgattcccctngtattatggatgtactgggtccncagactcgagggagggctggaggtggacggaccaaanataaacgcgaaagcgtaggaaacgtggtacccccgtaaggtttttacggnggtactccgtagggtacggaacggggtccctttaccgacctagtcctacgagacacaacgacaaagtattcatacgtatacgtaacaacgtacaacagacctagggacgagtcgacagaccgacggcgtagtattacgtggtcgngtaagagttaggtaaaggttaaaagtaacgttggttcgttggtttagttaagggttcgggggaacctaacggggggtcttaccccggtggttcccgttaaccccggg

SEQ ID NO: 411417 - DNA, 682 bp, Homo sapiens
  misc_feature: GZ8MTXP01AOS4Y.17.28.C06.1.454.CMB.2.raw
  modified_base (208)..(208): a, c, t, g, unknown or other
  modified_base (234)..(234): a, c, t, g, unknown or other
  modified_base (240)..(240): a, c, t, g, unknown or other
  modified_base (255)..(255): a, c, t, g, unknown or other
  modified_base (302)..(302): a, c, t, g, unknown or other
  modified_base (623)..(623): a, c, t, g, unknown or other
  modified_base (654)..(654): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccggnaggaggtcacatatctgtctagaacngctcgnatctacaactaactntttgctaggtaccagctaacttcccgaggactccccggacccccgtntcctcatctaataagaaatgactcacgtccggcccgtccggggtcctggaacccctgttcctcgtcggtcctaccgtagtcgtcgtacggcctacccgtcaccgtccctacccgtagaccctacgtcgtacgggtccgggtccgtacccggggtaccggtaaggtacgtacggggtacggttaccttaggttaaactttacggtttacgttcgggttacgaccgggtaaccgggtgggtactacggaacctacgttaccggtagttaacgggttccggggttaacgggttcggggttacggggaccggggacggtaaccgngggttccgttcggttacccgtcgtacggccncggacccgacgtccgttcccgtcccccg

SEQ ID NO: 411418 - DNA, 697 bp, Homo sapiens
  misc_feature: GZ8MTXP01CBUM4.17.28.C06.1.454.CMB.2.raw
  modified_base (212)..(212): a, c, t, g, unknown or other
  modified_base (247)..(247): a, c, t, g, unknown or other
  modified_base (255)..(255): a, c, t, g, unknown or other
  modified_base (269)..(269): a, c, t, g, unknown or other
  modified_base (627)..(627): a, c, t, g, unknown or other
  modified_base (645)..(645): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccctaccctcagtgtcgtcggggaccccccgggnaggacgggtccaccattatctttgtctaggaaacngctccggnatctacaataactnttttgctgtaccagcaatccaggactcccggcccccgctcctcactctatagaatgactacacgtccggccccgttcccggggtcccctggacccgtacgttccgtcgtacgggtccctcccgtaagttcggttccgtcgggtaccctacccgtcccgtaaccgtccccccgttacccccgtaccgggtaaccctaacggttcccgtacggggttcggggtaccccgttcccgggggttacccggggacgggtagtcggtaacggtcttaggtaattacgtttacggtgtcgtaccgtacgggtcgggattacggactacttccggtaggtagttcggggtaccggtgggtccggggnggaacgggttcgacggtnttaccggccgttacgtaagtcccgcgacctacggcctcccggccccgttcgg

SEQ ID NO: 411419 - DNA, 771 bp, Homo sapiens
  misc_feature: GZ8MTXP01C33UJ.17.28.C06.1.454.CMB.2.raw
  modified_base (188)..(188): a, c, t, g, unknown or other
  modified_base (210)..(210): a, c, t, g, unknown or other
  modified_base (243)..(243): a, c, t, g, unknown or other
  modified_base (251)..(251): a, c, t, g, unknown or other
tcagcgtagactagcacgaccggtgctcgatttagagctcacgtattggggtttggggcagcttcagctgtggtagagaagacaggattcaggacaatctccagcatggccggcttccctctcctcctcaccctcctcactcactgtgcagggtcctgggcccagtctgtgctgactcagccaccctnagtgtccgtcgggacccccggnaggacggtccacattactcttgttctagaaacngctccggnactactacaaacttaaactatttttcgctacggtaaccagtactaacttacccgaggaccttccccggaccccccactccctactaacttaccttaagtaaagaaaacgtcgtaactttaccgaacggttcccgggtccccccggtttcccgggggtaccccttaccggtaacccccggttctttccgtcgttcggtacccttaacccgtagttccggttccgtccgggaccccttaccctcccgaccgttacccctccccgttacgacctaacgttccggacgggttcccggggtacccggtaccgggttaccggaagggttacgtacggtacggtactttaggtaaccttttaggttaaccgtggttaccgacggtaccggtggtactacgtacgtacgtccgtaggtacggttcgggtaacggttcgggacgggacggcggtaacgcggttaccgttccgttacccgtaacgtaaccgcgaaccggtacccggacgtcccgttccccggtttccccg

SEQ ID NO: 411420 - DNA, 701 bp, Homo sapiens
  misc_feature: GZ8MTXP01BFZDM.17.28.C06.1.454.CMB.2.raw
  modified_base (302)..(302): a, c, t, g, unknown or other
  modified_base (402)..(402): a, c, t, g, unknown or other
  modified_base (669)..(669): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgttttagaaggtgtcagtgtgaggtcagttggttgaggtcgggagctgtcagcgtgggggtcctgagctctctgtgcagcctccggtacttccccttgagttagttatggatgtacgttcgggtaccnccaggacctcggaagggggacggggtcgtagggaggtgggtacgaccaaacgaagtaaagcaaaggagtcggaaactcggtaccccgttaggttttacgnggtacctggtagtacgggaacgggttcccttacaccctattcctacgaacgaacgaacccaacggaacctaaaggtacttacgaacttacgtacttaacccgtaacaaacgttacgaaactcgggaccttgggggaacgttcgggaccacgaaacgacccgtaccgggaccggtttagttaaacgtcgttgagggaccgtaagtaaggttacggtaaaagggttaaagtagtcggttagttggttagtttaacggggtgggaaccgnggggtacttcccgggtaagttcccgttaaccg

SEQ ID NO: 411421 - DNA, 770 bp, Homo sapiens
  misc_feature: GZ8MTXP01DTM7K.17.28.C06.1.454.CMB.2.raw
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcacgcccaccctcagtgtccgtccgggacccccggcaggacggtccaccattattcttgttctaggaaacacgctccggactatcctacaaactaaacttattttcgctggtaaccagactaacttcccgaggtaccgtcccggacccccccgaactccctctaattacctaataaacgtaaatcggactcctacgtcccggtcccccgttccggggtcccctacggtcccccgtactttcgttcgtcggtacccttccgtacttcggtctaccgggtccctacccgttccgaccgtccccttcccacccgtaaactcttcggtaacggtcgggtacccgttccggggtaccgaaggttcgaggaacgtcgtagttaccgtttaggttaacgtgggttacgccgttaaccggtagggtacgtcgtaaaccgtcttcggtttaacggtaacggtttcgggggtttaacccggggttggttccgggggacgggttacgggtaaaccggtcggacgttaccgggttaaccccgggttaacttaaacgggcccgtacccggtaccgggttaaccggtccttcccccgggttcccccgg

SEQ ID NO: 411422 - DNA, 643 bp, Homo sapiens
  misc_feature: GZ8MTXP01AQ4BV.17.28.C06.1.454.CMB.2.raw
  modified_base (286)..(286): a, c, t, g, unknown or other
  modified_base (315)..(315): a, c, t, g, unknown or other
  modified_base (406)..(406): a, c, t, g, unknown or other
  modified_base (441)..(441): a, c, t, g, unknown or other
  modified_base (586)..(586): a, c, t, g, unknown or other
tcagcgtagactagcacgaccggtgctcgatttagagctcacgtattggggtttggggaggtctcagagaggaggcttagccctggactccaaggcctttccacttggtgatcagcactgagcacagaggactcaccatggagttggggctgaacttgggttttccttgttgcttgttttagaaggtgtcagtgtgaggtcagttggtgaggtccgggggagcctggtccaggccgtgggggtccctgacgactctcctgtgcacgccctccggacttcccccttnagttagttatggatgtacgttgggtcccncagacctccgaaggggaggggctgggaggtggggtcggaccaaacaagtaaaagcaaagagtacggaaactggaccccgttagttttacgngggtactcgtagtggaacgggtccctttacacctntcctcaagacgaccaacgaccaaagtacttaccattagtactactaacaaactacgaacacgccgtgggaacgtagtccgacgacgacgaccgggtccgttagtattaccgtggtgacgaagtagttaggtaaaggaaaagtagnggttacgttggttgttttaagtcggcgaccggagggaccgtcccgttggttaacccg

SEQ ID NO: 411423 - DNA, 617 bp, Homo sapiens
  misc_feature: GZ8MTXP01E43BB.17.28.C06.1.454.CMB.2.raw
  modified_base (190)..(190): a, c, t, g, unknown or other
  modified_base (211)..(211): a, c, t, g, unknown or other
  modified_base (238)..(238): a, c, t, g, unknown or other
  modified_base (244)..(244): a, c, t, g, unknown or other
tcagcgtagactagcacgaccggtgctcgatttagagctcacgtattggggtttggggcagcttcagctgtggtagagaagacaggattcaggacaatctccagcatggccggcttccctctcctcctcaccctcctcactcactgtgcagggtcctgggcccagtctgtgctgactcacgcccaccctnagtgtcgtcggggaccccggnaggaggtcacatatcttgtcagaaacngctcgnatctacaactaactattttgaaaaactgtaacagactaacttacccgaggacctccccggcccccctactcctactatactaataagaaatgatacacgtccggtccccgtccgggtccctcgtaccccgtacttctcgtcggctaccagttcgtcgtcggaccctacctcgacgtccctcccgtacgaacctatcggacggtcgggtcccgtaccgggtacgaaggagtggacgtctagtatttacgtactgtcgacggtacgtggtactacgactactcgtagtacggtcgggtcggtggttcgggacgggacggacgcggccgttcggacctaacgagtccgacgcccgacggtcccgttcccgtccccg

SEQ ID NO: 411424 - DNA, 713 bp, Homo sapiens
  misc_feature: GZ8MTXP01A0KA7.17.28.C06.1.454.CMB.2.raw
  modified_base (281)..(281): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggagcctggtccagccgtgggggtcctgagactctcctgtgcacgccctccgtacttccccttnagtagttagtggatgtacgttgggtccgccagaccgtccggaggggaggggcgtgggaggtggggtcggaccaaacaagtaaagcaaagagtaggaactgtccccggttagttttacggtggtaccttcgtaggtacgggtaacggggtcccttttacaaccctatcctaaccagaacgaaccaaaccgaaccaaagtaactttacaacgtttacgttaacttacctaaacctaacgtacgtaaaccgacggtacccgttaggggaacggtacggtaccgacgaacggaaccgtaccgggtccgttaagttactttaacgtggtcgtacggaagtaagttaggttaaaggttaaaagttacgtgggttcgtttggttaggtttaagggtcggggaacgagggtaccgttcccgttcgggttccctaacccgg

SEQ ID NO: 411425 - DNA, 588 bp, Homo sapiens
  misc_feature: GZ8MTXP01BHGH2.17.28.C06.1.454.CMB.2.raw
  modified_base (214)..(214): a, c, t, g, unknown or other
  modified_base (221)..(221): a, c, t, g, unknown or other
  modified_base (233)..(233): a, c, t, g, unknown or other
  modified_base (236)..(236): a, c, t, g, unknown or other
  modified_base (278)..(278): a, c, t, g, unknown or other
  modified_base (299)..(299): a, c, t, g, unknown or other
  modified_base (377)..(377): a, c, t, g, unknown or other
  modified_base (449)..(449): a, c, t, g, unknown or other
  modified_base (453)..(453): a, c, t, g, unknown or other
  modified_base (469)..(469): a, c, t, g, unknown or other
  modified_base (474)..(474): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtccagtgtgagtcagttggtgaggtcgggngctgtcngcgtggggtccnganctctctgtgcacgtccctccgacttcccccttgtagtagttntggatggtacgttcgggtccncagcgtcggaggggagggctggaggtgggtcgaccaacaagtaaagcaaagagtaggaactgtaccgtaggtttacgnggtactcgtagtggaacggtccgtttcactctcctacagacgaacaccgacaagatcatagtatacagacanacgnctagggagtcgcgacngaccncggtcctgtacttcgaggtgcgaagtgttaaggtaaacgggttaaaagttgaggttcgttgggttacgtttgggtcggggtcgtacgggcgttcccggttcgcggttaaccccg

SEQ ID NO: 411426 - DNA, 550 bp, Homo sapiens
  misc_feature: GZ8MTXP01C9G33.17.28.C06.1.454.CMB.2.raw
  modified_base (205)..(205): a, c, t, g, unknown or other
  modified_base (303)..(303): a, c, t, g, unknown or other
  modified_base (360)..(360): a, c, t, g, unknown or other
  modified_base (405)..(405): a, c, t, g, unknown or other
  modified_base (409)..(409): a, c, t, g, unknown or other
  modified_base (427)..(427): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcgggaccccggnagaggtcaccatatcttgtctggaaacagctcggcatctacaactaactattttgctggtacagcaattcccaggactccggcccccgatcctcactntataagaaatgatctatcggccctcgggtcctgaccgtattcctcgtggcctcaatntcgtgccacctcagcctcctgaccatcgagtcggctccggtacgngtangagctgtattattacggngttcgacctaccggtgggatgacctatcccgtgacgtcgggtcccgtggttcgggcgggacggttccgaggtcttagcccgttactaacggtcaacggcccaaggccttccgccccgttaacg

SEQ ID NO: 411427 - DNA, 691 bp, Homo sapiens
  misc_feature: GZ8MTXP01DWH6U.17.28.C06.1.454.CMB.2.raw
  modified_base (245)..(245): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggagcctggtccagccgtgggggtcccngagactctcctgtgcagccctccggattcccctcagtattatggatgacgtcgggtccgccacgactccggaagggaggggctgggaggtgggtggccaaagaataaagacaagtagtacggaaacgtcgtaccccgtaggttttacgtggactcgttgtagtaacggggcccgttttacaccctatcctaccagacgtaccaacgacccaagtaactaccattaccgttatacctaacgaaccctgaaaccgagccccgtaggacggtaacgtcgacccgaaggaccgaaccgggccggtttacgtacgttttaacgtcgtggaccggttaaggaaagtttggggtaaagggttaaaaaggtaaagttgggttcccggtttagttacggtttttaaggttcggggccgggtacgggtcgttccccggtggttaaacccgtccccg

SEQ ID NO: 411428 - DNA, 609 bp, Homo sapiens
  misc_feature: GZ8MTXP02IO76P.17.28.C06.1.454.CMB.2.raw
  modified_base (240)..(240): a, c, t, g, unknown or other
  modified_base (266)..(266): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcgagggtcctcgggcccagtctgtgctgactcagccaccctcagtgtcgtcgggaccccgggcagagggtcaccatatcttgttctaggaaacngcctccggcatctacaaactaaactnttttgctggtaccagcaacttcccgaggactccccggccccccgactcctcactctaataagaaatgactcacgtcccggccccgtcccggggtccctaggacccgtacttcctcgtcggcctcccattcgtcgtcgccacctcacgcccttccctgactactcgtagtcgggccgtcccgggtacgaggtagtggacgtctgtatttaattacgtgttcgaccgtacggtggatcgactagtaccgtgtaagtcgggttccggttggttcgggacgggacgggtaccgacggccgtacgacccgttacgtaagtcgacgacccacggcctccgccccgtcgg

SEQ ID NO: 411429 - DNA, 493 bp, Homo sapiens
  misc_feature: GZ8MTXP02ILZBB.17.28.C06.1.454.CMB.2.raw
  modified_base (465)..(465): a, c, t, g, unknown or other
  modified_base (484)..(493): a, c, t, g, unknown or other
tcagcgtagactagcacgaccggtgctcgatttagagctcacgtattgggtttggggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggcccccgatcctcatctatagaaatgatcatcggccctccgggtccctgaccgattctctggctccatgtctggcacctcagcctccctgaccatcagtggctccggtcgaggatgaggctgattatactgtgcaccgtgggatgacatcctgaaatgggtcccgtgttcggcggagggaccaggctgaccgtcctaaagtcagcccaaggctgccccctggtcactctgttcccacctcctcctagtctacgctgngcgcgcgcgagcgcacagnnnnnnnnnn

SEQ ID NO: 411430 - DNA, 522 bp, Homo sapiens
  misc_feature: GZ8MTXP02F9E3F.17.28.C06.1.454.CMB.2.raw
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaacattttgctggtaccagcaattccccaggatcggccccccgactcctcatctatagaaatgatcatcggccctccggggtccctgaccccgattctctggctccatgtctggcacctcacgcctccctgaccatcagtggctccggtccgaggatgagctgattatactgtcgcgaccgtgggatgacatcctgaattgggtccggtggttcggcggagggacctaggctgaccgtctaacgtcacgcccaaggcctcgtcccccg

SEQ ID NO: 411431 - DNA, 524 bp, Homo sapiens
  misc_feature: GZ8MTXP02JBWV1.17.28.C06.1.454.CMB.2.raw
  modified_base (264)..(264): a, c, t, g, unknown or other
  modified_base (360)..(360): a, c, t, g, unknown or other
  modified_base (516)..(524): a, c, t, g, unknown or other
tcagcgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgatcctcatctatagaaatgatcatcggccctcgggtccctgaccgnttctctggctccatgtctggcacctcagcctccctgaccatcagtggctccggtccgaggatgaggctgattattactgtgcaccgtgggatgacntcctgaagttgggtccggtgttcgggcgggaggggacccaggctggacccgtccgtaaagtccgacgaccccaagggcctcgccccctcggtcactctcgttccccgccctcctcctacgtctacgctgagcgggctcggcaacggcgacatacgnnnnnnnnn

SEQ ID NO: 411432 - DNA, 539 bp, Homo sapiens
  misc_feature: GZ8MTXP02IPYSE.17.28.C06.1.454.CMB.2.raw
  modified_base (397)..(397): a, c, t, g, unknown or other
tcagcgtagactagcacgaccggtgctcgatttagagctcacgtattgggtttgggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggcagagggtcaccatatcttgttctggaaacagctccggcatctcaactaaacatttttgctggtaccagcaattcccaggactccggccccccgactcctcatctatagaaatgatcatccggccctccggggtccctgaccccgattcctctggctccatgtctggcacctcacgcctccctgaccatcagngggctccggtccgaggatgaggctagatttatactgtcgcgaccgtgggatgacagtcctagaatcgggtccgtggttccgggcggacgggaccagggcctggacccgttccgtaaagtcacgacccaggccttcgcccccg

SEQ ID NO: 411433 - DNA, 544 bp, Homo sapiens
  misc_feature: GZ8MTXP02I52Z2.17.28.C06.1.454.CMB.2.raw
  modified_base (380)..(380): a, c, t, g, unknown or other
  modified_base (464)..(464): a, c, t, g, unknown or other
  modified_base (533)..(533): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctgggggtccctgagactctcctgtgcagcctccggattccccttcagtagttattggatgacttgggtcccgccagactccagggaaggggctggagtgggtggccaaacataaaagcaaagatggaaactgcccgagttttacgnggactctgtgaggggcctttcaccatcctcagagacaacgccaaagaattcactgtatctacaactgaacagcctgagagtcgnagacacggccgtgtaattactgtgcgagatgtaggaaaaagtatcggctgtgttaagtggggcaggganccctggtcacg

SEQ ID NO: 411434 - DNA, 552 bp, Homo sapiens
  misc_feature: GZ8MTXP02JOD2F.17.28.C06.1.454.CMB.2.raw
  modified_base (300)..(300): a, c, t, g, unknown or other
  modified_base (368)..(368): a, c, t, g, unknown or other
  modified_base (474)..(474): a, c, t, g, unknown or other
  modified_base (534)..(534): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctggggggtccctgagactctcctgtgcagcctccggattccccttcagtagttatggatgacttgggtccnccagactccagggaagggctggagtgggtggccaacataaaagcaagatggaactgccgagtttacgnggactctgtgaagggccgtttcacatctccagagacaaacgccaaagaattcactgtatcaacaactgaaacagcctgagagtcgcagacacggccgtgtattacngtgcgagataggtaggaaaaagtatgggcttggttagtttagtgggggaccagggggacncccgtgggtccaccgtcc

SEQ ID NO: 411435 - DNA, 511 bp, Homo sapiens
  misc_feature: GZ8MTXP02IHR0T.17.28.C06.1.454.CMB.2.raw
  modified_base (500)..(500): a, c, t, g, unknown or other
  modified_base (502)..(511): a, c, t, g, unknown or other
tcagcgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaaacatttttgctggtaccagcaattcccaggatccggccccccgatcctcatctatagaaatgatcatcggcccctcggggtccctgacccgattctctggctccatgtctggcacctcagcctcccctgaccatcagtggctcggtccgaggatgaggctgattatactgtgcacgtgggatgacatcctgaaagtggtcccggtgttcgggcggacggggacaggctcgaccgtctaagtcacgccaaggctcgcccctcggtcacgtctcgttcccaccctcctctacgtctacgctgacgcgggctggcaacggcgacanannnnnnnnnn

SEQ ID NO: 411436 - DNA, 498 bp, Homo sapiens
  misc_feature: GZ8MTXP02J0BD9.17.28.C06.1.454.CMB.2.raw
  modified_base (362)..(362): a, c, t, g, unknown or other
  modified_base (488)..(498): a, c, t, g, unknown or other
tcagcgtagactagcacgaccggtgctcgatttagagctcacgtattgggtttgggggtgtggtggtctccactcccgcccagtctgtgctgactcagccaccctcagtgtctgggaccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtggctccggtcgaggatgaggctgattatactgtgcaccgtggatgacatccngaatggtccgtgttcggcggagggaccaggctgaccgtctaagtcagcccaaggcctcgccccctggtcactctgttccccaccctcctcctagtctacgctgagcgggctcggcaggcgcatagnnnnnnnnnnn

SEQ ID NO: 411437 - DNA, 516 bp, Homo sapiens
  misc_feature: GZ8MTXP02GPO61.17.28.C06.1.454.CMB.2.raw
  modified_base (235)..(235): a, c, t, g, unknown or other
  modified_base (444)..(444): a, c, t, g, unknown or other
  modified_base (506)..(506): a, c, t, g, unknown or other
tcagcgtagactagcacgaccggtgctcgatttagagctcacgtattgggtttgggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacngctccggcatctcaactaaacattttgctggtaccagcaaattcccaggatcggccccccgactcctcatctatagaaatgatcatcggccctccggggtccctgaccgacttctctggctccattgtctggcacctcagcctccctgaccatccagtgggctccggtcgacggatgaggctgattattactgtgcaccgtggatgacntctgaatgggtccgtgttcggcggagggaccaggctcgaccgtcctaagtcagcccaaggcncgcccctcgg

SEQ ID NO: 411438 - DNA, 518 bp, Homo sapiens
  misc_feature: GZ8MTXP02GFJOU.17.28.C06.1.454.CMB.2.raw
  modified_base (353)..(353): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggcagagggtcaccatatcttgttctggaaacagctccggcatctcaactaaacattttgctggtaccagcaattccccaggatccggccccccgatcctcatctatagaaatgatcatccggccctccggggtccctgaccccgattcnctcggctcccatgtctggccacctcagcctccctgaccatcagtcggctccggtccgaggactgagctgattattactgtgcacgtggactgacatctgaagtggtccggtgttcggcggacgggacaggctgaccgtcctaagtcacgccaggcctcgcccccg

SEQ ID NO: 411439 - DNA, 510 bp, Homo sapiens
  misc_feature: GZ8MTXP02F01GE.17.28.C06.1.454.CMB.2.raw
  modified_base (234)..(234): a, c, t, g, unknown or other
  modified_base (242)..(242): a, c, t, g, unknown or other
  modified_base (365)..(365): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggcagagggtcaccatatcttgtctggaaacngctccggnatctcaactaaacattttgctggtaccagcaattcccaggactccggcccccgactcctcatctatagaaatgatcatcggccctccggggtcctgaccgattctctggctccatgtctccgnacctcagccctcctgaccatcagtcggctcccggtccgaggactgagctgattatactgtgcacgtggatgacatcctgaatggtccgtgttcggcggaggaccaggctcgaccgtctaagtcacgcccaaggctcgcccctcgg

SEQ ID NO: 411440 - DNA, 564 bp, Homo sapiens
  misc_feature: GZ8MTXP02IE2P3.17.28.C06.1.454.CMB.2.raw
  modified_base (336)..(336): a, c, t, g, unknown or other
  modified_base (370)..(370): a, c, t, g, unknown or other
  modified_base (376)..(376): a, c, t, g, unknown or other
  modified_base (390)..(390): a, c, t, g, unknown or other
  modified_base (402)..(402): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggtgagtccgggagcctggtcagcctgggggtcctgagactctcctgtgcagcctccggacttcccctcagtagttattggatgacttgggtccgccagactccgagggaaggggctggagtgggtggccaanataaagcaaagatggaactgcccgtagtttacgnggactntgtgaggccgtttnaccatctcaganacaacgccaaagattcactgtatctaacaactgaaacagcctagacgagtcgacagacacggcgtgtattacgtgtgacgagatggtaaggaaaaagttatcgggacttggttagtttaagttcgggggacctaggggacgtccccgtaggtacctacccgg

SEQ ID NO: 411441 - DNA, 542 bp, Homo sapiens
  misc_feature: GZ8MTXP02IV4B8.17.28.C06.1.454.CMB.2.raw
  modified_base (236)..(236): a, c, t, g, unknown or other
  modified_base (244)..(244): a, c, t, g, unknown or other
  modified_base (535)..(535): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggcagagggtcaccatatcttgttctggaaacngctccggnatctcaactaaacattttgctggtaccagcaattcccaggactccggcccccgactcctcatctatagaaatgatcactcggccctccggggtccctcgaccccgattcctctcggctccatgtctggccacctcacgccctccctcgaccatcaggtcggccgtccggtccgaggacgtgaggctagtatttagttacttgtgccaccggtggatgacatcctgaagtcggtcgtggttcgggcggacggaccgcgcgtcgaccgtaacgtacgtcgacgaccgacgtcnccgcccg

SEQ ID NO: 411442 - DNA, 566 bp, Homo sapiens
  misc_feature: GZ8MTXP02GG68V.17.28.C06.1.454.CMB.2.raw
  modified_base (551)..(551): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctgggggtccctgagactctcctgtgcagcctccggattccccttcagtagttattggatgacttgggtccgccagactccgagggaaggggctggagtggggtggccaacataaagcaaagatggaaactgccccgtagtttacgtggactctgtgaggggccgtttcaccatctccagagacaacgccaaagaattcactgtactctaacaactagaacagcctgagagtcgacagacacggccgtagtattactgtgcgaagatggtaaggaaaaagtagtcggactgttagtttaagttggggccgaggggacncccgtggtcctaccg

SEQ ID NO: 411443 - DNA, 546 bp, Homo sapiens
  misc_feature: GZ8MTXP02F21D0.17.28.C06.1.454.CMB.2.raw
  modified_base (236)..(236): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggcagagggtcaccatatcttgttctggaaacngctccggcatctcaactaaacattttgctggtaccagcaattccccaggactccggccccccgactcctcatctatagaaatgatcatcggcccctccggggtccctgaccccgattcctctggctccatgtctggcacctcacgccctccctgacccatcaggtcgggccttcccgggtccgagggactgaggctagtattattactgtgcaccgtgggatgactatcctagaactgggtcccggttgttcgggcggtagggaccagggctcggaccgtccgtaagtcacgcccaaggcctcgcccccg

SEQ ID NO: 411444 - DNA, 558 bp, Homo sapiens
  misc_feature: GZ8MTXP02IQH9F.17.28.C06.1.454.CMB.2.raw
  modified_base (481)..(481): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctgggggtccctgagactctcctgtgcagcctccggattccccttcagtagttattggatgacttgggtccgccagactccgagggaaggggctggagtgggtggccaacataaagcaaagatggaaactgcccgagtttacgtggactctgtgaggggccgtttcaccatctccagagacaacgccaaagaattcactgtatctacaactgaaacagcctgagagtcgcagacacggcgtgtattacngtgcgagatggtaggaaaaagtatggacttggttgtttaagttgggggacctaggggacgcccgtggtcctacccgg

SEQ ID NO: 411445 - DNA, 568 bp, Homo sapiens
  misc_feature: GZ8MTXP02JRNFH.17.28.C06.1.454.CMB.2.raw
  modified_base (377)..(377): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattccccttcagtagttattggatgacttgggtccgccagactccgagggaaggggctgggagtgggtggccaacataaagcaagatggaactgccccgtagttttacgnggactctgtgaggggtcctttcaccatctccagagacacgaccaagatcactgtactctacaactagaacagcctagagagtcgcgagaccacggccgtgtacttactgtgcgagagtggtaaggaaaaagtagtaggcttaggttgtttaagttgggggacctaggggacgtccgtacgggtctacccgg

SEQ ID NO: 411446 - DNA, 571 bp, Homo sapiens
  misc_feature: GZ8MTXP02G1ZBQ.17.28.C06.1.454.CMB.2.raw
  modified_base (379)..(379): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctgggggtccctgagactctcctgtgcagcctccggattccccttcagtagttattggatgacttgggtccgccagactccgaggggaaggggctggagtgggtggccaacataaagcaagatggaactgccccgtagttttacgnggactctgtgaggggtccgtttcaccatctcagagacaacgccaaagaattcactgtatctaacaactgaacagcctagacgagtcgcaagacacggcgtagtattactgtgcgagagtagtaaggaaaaagtaaagtggacgttgttagtttaagttggggaccgagggacgtcccgtcggtacgtacccg

SEQ ID NO: 411447 - DNA, 521 bp, Homo sapiens
  misc_feature: GZ8MTXP02GHJOZ.17.28.C06.1.454.CMB.2.raw
  modified_base (362)..(362): a, c, t, g, unknown or other
  modified_base (512)..(521): a, c, t, g, unknown or other
tcagcgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatccggccccccgactcctcatctatagaaatgatcatcggccctccgggtccctgaccgattctctggctccatgtctggcacctcacgcctccctgaccatcagtggctccggtccaggatgaggctgattattactgtgcacgtgggatgacntcctagaagtgggtccggtgttccgggcggagggaccaggcgtgacccgtctaagtcaacgccccgaagcctcgcccccgtggtccacctctcgttccccgccctccctcctagtcctacgctgagcgggctcggcaacggcgacagagnnnnnnnnnn

SEQ ID NO: 411448 - DNA, 549 bp, Homo sapiens
  misc_feature: GZ8MTXP02ISJBY.17.28.C06.1.454.CMB.2.raw
  modified_base (374)..(374): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagcctgggggtccctgagactctcctgtgcagcctccggattcccctcagtagttattggatgacttgggtccgccagactccaggggaaggggctggagtgggtggccaacataaagcaagatggaactgcccgtagtttacgngactctgtgagggcctttcaccatctcagagacaacgccaagaatcatacgtatactaacaactgaacagcctagagagtcgacagacacggcgtgtattactgtgacgagataggagaaaaagtatacggcttgttagttaagttggggaccgagggacgccgtcggtctaccg

SEQ ID NO: 411449 - DNA, 564 bp, Homo sapiens
  misc_feature: GZ8MTXP02I3RJX.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtgggggtccctgagactctcctgtgcagcctccggattccccttcagtagttattggatgacttgggtccgccagactccgagggaaggggctggagtgggtggccaacataaagcaaagatggaaactgccccgtagtttacgtggactctgtgagggccgtttcaccatctccagagacaacgccaagaattcactgtatctacaactagaaacagcctagagagtcgacagaccacggccgtgtattactgtgcgagatgtaggaaaaagtactggacttgtagtttaacgttgggggaccaggggacgccccgtgggtcctaccg

SEQ ID NO: 411450 - DNA, 644 bp, Homo sapiens
  misc_feature: GZ8MTXP02IH9LW.17.28.C06.1.454.CMB.2.raw
  modified_base (240)..(240): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtcgtcgggaccccggcaggagggtcaccatatcttgttctaggaaacngctccggcatctacaactaaactattttgctggtaccagcaacttcccaggactcccggccccccactcctcatctaatagaaatgactcactccggccccgtccggggtcctcgaccccgtattcctctcggctccatcgtctcggcctaccctcacgtccctcccgtacgaccactcgaggtcgggtccgtcccgggtacccgaggtacgtggacggtcgtagtaactttagttacgttgtcgtacgtaccggtgggatacgacgtacttccgtaggtaaacgttcgggttccgggttgggtttaccgggggacgggtaacggggaccgtacgggtaccgttacggtacccggttaaccgtaaacgtccgacggacccgaacgggtcctacccggtcccccg

SEQ ID NO: 411451 - DNA, 543 bp, Homo sapiens
  misc_feature: GZ8MTXP02I92DD.17.28.C06.1.454.CMB.2.raw
  modified_base (426)..(426): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctaaccctcctcactcactgtgcagggtcctgggcccagtctgtgctgactcagccaccctcagtgtctgggaccccggcagagggtcaccatatcttgttctggaaacagctccggcatctcaactaacattttgctggtaccagcaattcccaggatccggcccccgactcctcatctatagaatgatcatcggccctccggggtccctcgaccgattcctctggctccatgtctggcacctccacgcctccctcgaccatcagtcgggcgtccggtccgagctgaggctgattatctgngcacgtggatgacgactcgtgtaacgtgggtccggtcggtttcggcgggacgggtaccgacggcgtccgtaccgtccgtaacgcgactcccgacggccttccgccccgtcggtcccg

SEQ ID NO: 411452 - DNA, 546 bp, Homo sapiens
  misc_feature: GZ8MTXP02GZP8J.17.28.C06.1.454.CMB.2.raw
  modified_base (372)..(372): a, c, t, g, unknown or other
  modified_base (393)..(393): a, c, t, g, unknown or other
  modified_base (478)..(478): a, c, t, g, unknown or other
  modified_base (531)..(531): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtcagttggttgagtccggggagcctggtccagcctggggtgtccctgagactctcctgtgcagcctccggattccccttcagtagttattggatgacttgggtccgccagactccagggaaggggctggagtgggtggccaacataaagcaaagatggaaactgccccgtagtttacgnggactctgtgagggccgtttnaccatctccagagacaacgccaaagaattcactgtatctaacaactgaaacagcctagagagtcgcagacacggcgtgtattacngtgcgagatggtaaggaaaaagtaatggctgttgtttaagtggggaccagggncccgtggtctacccg

SEQ ID NO: 411453 - DNA, 557 bp, Homo sapiens
  misc_feature: GZ8MTXP02IHNTP.17.28.C06.1.454.CMB.2.raw
  modified_base (303)..(303): a, c, t, g, unknown or other
  modified_base (372)..(372): a, c, t, g, unknown or other
  modified_base (378)..(378): a, c, t, g, unknown or other
  modified_base (438)..(438): a, c, t, g, unknown or other
  modified_base (442)..(442): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaggtgtccagtgtgaggtcagttggttgaggtccggggagcctggtccagccgtgggggtccctgagactctcctgtgcagccctccggattccccttcagttagttattggatgacttggtccncagactccgagggaggggctggaggtggtgaccaacataaagcaagatggaactgcccgtagtttacgnggactntgtgaggggtcctttcaccatctccagagacaacgctaaagattcatgattcacaacganacancagagagacgacgacgacgacgtcgtagtattatgtgagagagtagtaagtaaaagtaaagtagtacgttgttagtttaaggttagggtacggacggtacgtccgtcgtacgtcg

SEQ ID NO: 411454 - DNA, 589 bp, Homo sapiens
  misc_feature: GZ8MTXP02JE8ZQ.17.28.C06.1.454.CMB.2.raw
  modified_base (375)..(375): a, c, t, g, unknown or other
  modified_base (395)..(395): a, c, t, g, unknown or other
  modified_base (408)..(408): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctgggggtccctgagactctcctgtgcagcctccggattcccctcagtagtatggatgacttggtccgccagactccgagggaaggggctggagtgggtggccaacataaagcaaagatggaaactgaccccgtagtttacgngactctgtgaggggcctttnaccatctccaganacaacgccaaagaattcaactgtactctaacaactagaaacagcctagaagagtcgacaagaccgacgggcccgttagtacttacgtgtgacgagagtaggtaaaggaaaaagtagtcggacttggttagtttaaggttcgggggaccgagggggacgtccccgttagggtacctacccgg

SEQ ID NO: 411455 - DNA, 639 bp, Homo sapiens
  misc_feature: GZ8MTXP02HRT3S.17.28.C06.1.454.CMB.2.raw
  modified_base (236)..(236): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggaccccggcagagggtcaccatatcttgttctggaaacngctccggcatctacaaactaaactattttgctggtaccagcaacttcccaggactccggcccccactcctcatctaatagaaatgatcatccgcccgtcccggggtcctcgacccgacttcctctcgctccatgtctcggcaccctcacgccctccctcgaacccactacgacggtcggggtcccgttcccggtcccggtaggactgggacggtctaggttaatttacttacgttggtcgtaccgtaaccgggtgggactacggactacgttaccgtaggtaaacgttcgggttccgggttcgggttccggggacgggacggggtaacccgcgggtaccgtcggtaaccgtaacccgtaaggtacccgaaccggacccgaacgggcctttacccggccccccg

SEQ ID NO: 411456 - DNA, 488 bp, Homo sapiens
  misc_feature: GZ8MTXP02H1P7I.17.28.C06.1.454.CMB.2.raw
  modified_base (267)..(267): a, c, t, g, unknown or other
  modified_base (355)..(355): a, c, t, g, unknown or other
  modified_base (468)..(468): a, c, t, g, unknown or other
  modified_base (475)..(475): a, c, t, g, unknown or other
  modified_base (478)..(478): a, c, t, g, unknown or other
  modified_base (480)..(488): a, c, t, g, unknown or other
tcagcgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccatcctcatctatagaaatgatcatcggccctcgggtccctgaccgattcnctggctccatgtctggcacctcagcctcccctgaccatcagtggctccggtcgagatgaggctgattatactgtgcacgtggatgacntcctgaatgtccgtgtcggcggaggaccaggctgaccgtcctaagtcagcccaaggctcgccccctcggtcactctcgttccccaccctctcctagtctacgctgagcggcgngcacgcncanannnnnnnnn

SEQ ID NO: 411457 - DNA, 587 bp, Homo sapiens
  misc_feature: GZ8MTXP02GP4CB.17.28.C06.1.454.CMB.2.raw
  modified_base (207)..(207): a, c, t, g, unknown or other
  modified_base (237)..(237): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggnagagggtcaccatatcttgttctggaaacngctccggcatctacaactaaactattttgctggtaccagcaattcccaggactccggcccccgactcctcatctatagaatgatcactccggcccgtccggggtccctgaccgacttctctggctcattcgtctcgcacctcacgcctccctgacccatcagtcgggcctcccggtcgaggatggagtctgtatttacttacgtgtcgcgtacgggtggactcgacagtcctagtacgttcggggtccggttggttccgggacgggacgggtaccgacgggtccgtacggaccccgttaccgtaaacggtccgaacggtaccccgaaggtccctccggtcccccgttcgg

SEQ ID NO: 411458 - DNA, 551 bp, Homo sapiens
  misc_feature: GZ8MTXP02IFSGJ.17.28.C06.1.454.CMB.2.raw
  modified_base (377)..(377): a, c, t, g, unknown or other
  modified_base (538)..(538): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctgggggtccctgagactctcctgtgcagcctccggattccccttcagtagtattggatgacttgggtccgccagactccgaggggaaggggctggagtggggtggccaacataaagcaagatggaactgcccgagttttacgnggactctgtgaggggccgtttcaccatctcagacgaacaacgaccaaagaattcacttgtatctaacaactagaacagcctgagagtcgacagacacggcctgtattactgtgcgagatggaagaaaagtatggactggtgtttaagtggggacaggggancccgtggtcaccg

SEQ ID NO: 411459 - DNA, 560 bp, Homo sapiens
  misc_feature: GZ8MTXP02IHENQ.17.28.C06.1.454.CMB.2.raw
  modified_base (462)..(462): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggttgagtccgggggagcctggtccagcctgggggtccctgagactctcctgtgcagccctccggattccccttcagtagttattggatgacttggtccgccagactccgagggaaggggctggagtgggtggccaacataaagcaagatggaaactgccccgtagttttacgtgactctgtgaggggtccgtttcacctatcctccagagacacgccaaagattcactgtatctacaactgaacagcctgagagtcgnagacacggccgtgtattactgtgcgagtatgtaggaaaaagtagtcgacttgttagtttaagttgggggaccaggggacgtcccgtggtacctacccg

SEQ ID NO: 411460 - DNA, 520 bp, Homo sapiens
  misc_feature: GZ8MTXP02H02LM.17.28.C06.1.454.CMB.2.raw
  modified_base (187)..(187): a, c, t, g, unknown or other
  modified_base (206)..(206): a, c, t, g, unknown or other
  modified_base (234)..(234): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctnagtgtctgggacccccggnagaggtcaccatatcttgtctggaaacngctccggcatctcaactaaacattttgctggtaccagcaattcccagactcggcccccgatcctcatctatagaaatgatcatccggccctccggggtcctgaccccgattcctctcggctccatgtctggccacctcagcctccctcgacatcagtcggctccggtccgagactgagctagtattattactgtcgcaccgtggatgacactcctagaagtggtcgtgttcggcggacggacacgctcgaccgtaacgtagtacacgacccaacggctcgcccccg

SEQ ID NO: 411461 - DNA, 562 bp, Homo sapiens
  misc_feature: GZ8MTXP02H40MH.17.28.C06.1.454.CMB.2.raw
  modified_base (379)..(379): a, c, t, g, unknown or other
  modified_base (412)..(412): a, c, t, g, unknown or other
  modified_base (438)..(438): a, c, t, g, unknown or other
  modified_base (453)..(453): a, c, t, g, unknown or other
  modified_base (458)..(458): a, c, t, g, unknown or other
  modified_base (478)..(478): a, c, t, g, unknown or other
  modified_base (484)..(484): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtgggggtccctgagactctcctgtgcacgcccccggattccccttcagtagttattggatgacttggtccgccagactccgagggaaggggctggagtgggtggccaaacataaagcaaagataggaactgccgtagtttacgngactctgtgaaggtccgtttcacatctccaganacaacgccaaagatcactgtatctanaactgaacagctganagtcncagacacggctagtatctgngcgagntagtaggaaaaatacgtggtactggttagttagttcgggggcctaagggggactcccggtcggtaccgtaccgtcccg

SEQ ID NO: 411462 - DNA, 573 bp, Homo sapiens
  misc_feature: GZ8MTXP02FX43R.17.28.C06.1.454.CMB.2.raw
  modified_base (301)..(301): a, c, t, g, unknown or other
  modified_base (374)..(374): a, c, t, g, unknown or other
  modified_base (486)..(486): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagctggtccagccgtgggggtccctgagactctcctgtgcagcctccggattccccttcagtagttatggatgacttggtccncagactccagggaaggggctggagtgggtggccaaacataaagcaaagatggaactgccccgtagttttacgnggactctgtgagggcctttcacatctcagagacaacgccaagaattcaactgtatctaacaactagaaacagcctgaagacgtcgacagacgacggaccgtgttaacttacngtgcgagtataggtaaggaaaaagtagtacgggacttggttagtttaacgttgggggaccgaggggacgcccgtgggtacctacccg

SEQ ID NO: 411463 - DNA, 568 bp, Homo sapiens
  misc_feature: GZ8MTXP02HRICE.17.28.C06.1.454.CMB.2.raw
  modified_base (376)..(376): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtggggggtccctgagactctcctgtgcagcctccggacttccccttcagtagttattggatgacttgggtccgccagactccgaggggaaggggctggagtgggtggccaacataaagcaagatggaactgccgtagtttacgngactctgtgaagggccgtttcacatctcagagacaacgccaagattcactgtatctacaactgaacagcctgagagtcgacagacacggccgtgtattactgtgacgagataggtaaggaaaaagtaagtcggtacttggttagtttagttgggggaccaagggggtcgccccgtagggtcctacggttccc

SEQ ID NO: 411464 - DNA, 551 bp, Homo sapiens
  misc_feature: GZ8MTXP02JV92K.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattccccttcagtagttattggatgacttgggtccgccagactccgagggaaggggctggagtggggtggccaacataaagcaaagatggaactgccccgtagtttacgtggactctgtgaggggcctttcacatctccagagacaacgccaagaattcactgtatctaacaactgaacagcctgagagtcgacagacacggccgtgtattactgtgcgagatggaggaaaagtagtggctgttagttaagttcggggccaggggacgcccgtggtctacccgg

SEQ ID NO: 411465 - DNA, 566 bp, Homo sapiens
  misc_feature: GZ8MTXP02GAQRT.17.28.C06.1.454.CMB.2.raw
  modified_base (237)..(237): a, c, t, g, unknown or other
  modified_base (472)..(472): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggcagagggtcaccatatcttgttctggaaacngctccggcatctacaaactaactattttgctggtaccagcaacttccccaggactccggccccccgactcctcatctatagaaatgatcagtccggccccgtccggggtccctgaccccgtattcctctcggctccatcgtctggccacctcacgccctccctcgaccatcaggtcggccgtccggtccgagagtgacggctagtattagttacgtgtcgtaccggtggatgacntctgagtggtccggtggtcgggcggacgggaccgacggtccgtcgaccgtacgtaaacgtccgaacggcccaaggtcctccgtcccccgtacgg

SEQ ID NO: 411466 - DNA, 554 bp, Homo sapiens
  misc_feature: GZ8MTXP02JWJEN.17.28.C06.1.454.CMB.2.raw
  modified_base (376)..(376): a, c, t, g, unknown or other
  modified_base (383)..(383): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattccccttcagtagttattggatgacttgggtccgccagactccgagggaaggggctggagtgggtggccaacataaagcaaagatggaactgccccgagttttacgnggactcngtgaggggccttcaccatctcagagacaacgccaagaattcactgtatctacaactgaacagcctgagagtcgcagacacggccgtgtatactgtgcgagatggtaggaaaaagtagtggactgttagtttaagttcggggacctaggggacgtcccgtggtcctacccgg

SEQ ID NO: 411467 - DNA, 622 bp, Homo sapiens
  misc_feature: GZ8MTXP02IVBWB.17.28.C06.1.454.CMB.2.raw
  modified_base (383)..(383): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctgggggtccctgagactctcctgtgcagccctccggattccccttcagtagttattggatgacttgggtccgccagactccgagggaaggggctggagtgggtggccaacataaaagcaaagagtaggaactcgacccgtagttttacgnggactcgtggtagacggggtccgtttacacctatcctcagacgacaaccgacaaagtaattacactagtactactaacaactagaacacgtcctagaggtagcgacgagtaccgacgggtccgtagtaacttacgtgtacgacggtagagttggtaaaaggtaaaaagtacgttcgggacttggtttaggtttaacggtcggggaccgtagggggacctccccgtggtaccctacccgg

SEQ ID NO: 411468 - DNA, 564 bp, Homo sapiens
  misc_feature: GZ8MTXP02JFLV5.17.28.C06.1.454.CMB.2.raw
  modified_base (374)..(374): a, c, t, g, unknown or other
  modified_base (485)..(485): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattcccctcagtagttattggatgacttgggtccgccagactccagggaaggggctggagtgggtggccaacataaagcaagatggaaactgccccgagttttacgnggactctgtgagggccgtttcacctatctccagagacaacgaccaaagaattcaactgtatctaacaaactgaaacagcctgagagtcgcagacacggtccgtgtattacngtgcgagatggtaggaaaaagtagtacggactgttagttaagttggggaccgaggggacgtcccgtggtacctacccgg

SEQ ID NO: 411469 - DNA, 505 bp, Homo sapiens
  misc_feature: GZ8MTXP02GBXKK.17.28.C06.1.454.CMB.2.raw
  modified_base (497)..(505): a, c, t, g, unknown or other
tcagcgtagactagcacgaccggtgctcgatttagagctcacgtattgggtttgggggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatccggccccccgactcctcatctatagaaatgatcatcggccctccggggtccctgaccgattctctggctccatgtctggcacctcagccctccctgaccatcagtggctccggtcgaggatgaggctgattatactgtcgcaccgtggatgacatcctgaatgggtccgtgttcggcggagggaccaggctgaccgtctaagtcagcccaaggctcgccccctggtccacgtctcgtccccaccctcctcctacgtctacgctgacgtcgggctcggcaaggcgcatgnnnnnnnnn

SEQ ID NO: 411470 - DNA, 566 bp, Homo sapiens
  misc_feature: GZ8MTXP02G9BIB.17.28.C06.1.454.CMB.2.raw
  modified_base (373)..(373): a, c, t, g, unknown or other
tcagcgtagactagcacgaccggtgctcgatttagagctcacgtattgggtttggggaggtctcagagaggagacttagccctggactccaaggcctttccacttggtgatcagcactgagcacagaggactcaccatggagttggggctgaactgggttttccttgttgctgttttagaaggtgtccagtgtgaggtccagttggttgagtcggggagcctggtccagcctgggggtccctgagactctcctgtgcagcctccggattccccttcagtagttattggatgacttggtccgcagactccgagggaaggggctggagtgggtggccaacataaagcaagatggaactgaccccgtagtttacgngactctgtgaggggtcctttcaccatctccagagacaacgccaaagaattcactgtatctaacaactagaacagcctagagagtcgcagaccacggccgtagtattactgtgcgagagtaggtaaggaaaaagtagtcggacttgttaggtttaagtcggggacctaggggacgtcccgtgggtcctacccgg

SEQ ID NO: 411471 - DNA, 564 bp, Homo sapiens
  misc_feature: GZ8MTXP02IX6VX.17.28.C06.1.454.CMB.2.raw
  modified_base (277)..(277): a, c, t, g, unknown or other
  modified_base (303)..(303): a, c, t, g, unknown or other
  modified_base (377)..(377): a, c, t, g, unknown or other
  modified_base (411)..(411): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattccccttnagtagttattggatgacttgggtccnccagactccgagggaaggggctggagtgggtggccaacataaagcaaagatggaaactgccccgtagtttacgnggactctgtgaggggccgtttcaccatctcaganacaacgccaaagaattcactgtatctacaactgaacagcctgagagtcgcagacgacggccgtgtaacttactgtagcgagatgtaggaaaaagtatgggtactgttagttaagttcgggggacctaggggacgcccgtgggtacctacccgg

SEQ ID NO: 411472 - DNA, 559 bp, Homo sapiens
  misc_feature: GZ8MTXP02GSXGF.17.28.C06.1.454.CMB.2.raw
  modified_base (375)..(375): a, c, t, g, unknown or other
  modified_base (483)..(483): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattccccttcagtagttattggatgacttgggtccgccagactccagggaaggggctggagtgggtggccaacataaagcaagatggaaactgccccgtagtttacgnggactctgtgagggccgtttcaccatctcagagacaacgccaaagatcactgtatctaacaactgaacagcctgagagtcgcagaccacggccgtgtattacgtgtgngagataggtaaggaaaaagtagtggtactgttagtttaagttggggaccagggggtacgcccgtggtccgtacccg

SEQ ID NO: 411473 - DNA, 552 bp, Homo sapiens
  misc_feature: GZ8MTXP02JRMOH.17.28.C06.1.454.CMB.2.raw
  modified_base (378)..(378): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattccccttcagtagttattggatgacttgggtcccgccagactccgagggaaggggctggagtgggtggccaacataaagcaaagatggaaactgccccgtagtttacgnggactctgtgaggggcctttcaccatctccagagacaacgccaagaattcactgtatctaacaactgaacagcctagagagtcgcaagacacggccgtgtattactgtgcgagatggtaggaaaaagtagtggactgtgttaagtggggaccaggggacgcccgtggtctaccg

SEQ ID NO: 411474 - DNA, 559 bp, Homo sapiens
  misc_feature: GZ8MTXP02G9WYY.17.28.C06.1.454.CMB.2.raw
  modified_base (412)..(412): a, c, t, g, unknown or other
  modified_base (543)..(543): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctgggggtccctgagactctcctgtgcagcctccggattccccttcagtagttattggatgacttgggtccgccagactccgaggggaaggggctggagtgggtggccaacataaagcaagatggaactgccccgtagtttacgtgactctgtgagggtccgtttcaccatctccaganacaacgccaagaattcactgtatctaacaactagaacagcctagagtagtcgcgaagacacggccgtagtattactgtgcgagatggaagaaaaagtagtcgctgttagttaagtcggggaccaggggacnccgtaggtcctacccg

SEQ ID NO: 411475 - DNA, 565 bp, Homo sapiens
  misc_feature: GZ8MTXP02HGPCW.17.28.C06.1.454.CMB.2.raw
  modified_base (548)..(548): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtggggggtccctgagactctcctgtgcagcctccggattccccttcagtagttattggatgacttgggtccgccagactccgagggaaggggctggagtgggtggccaacataaagcaaagatggaaactgccccgtagtttacgtggactctgtgagggcctttcaccatctccagagacaacgccaaagaacttcactgtatctacaactgaacagcctagacgagtcgacagaccacggccgtgtacttactgtgcgagagtggtaaggaaaagtatacggctagttgtttaagtgggggaccaggggancccgtggtcctacccgg

SEQ ID NO: 411476 - DNA, 670 bp, Homo sapiens
  misc_feature: GZ8MTXP02IODVR.17.28.C06.1.454.CMB.2.raw
  modified_base (211)..(211): a, c, t, g, unknown or other
  modified_base (243)..(243): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcgagggtccgtcgggcccagtctgtgctgactcacgccaccctcagtgtcgtcggggaccccggnaggagggtcaccatatcttgttctaggaaacngctccggcatctacaaactaaactattttgctcggtaaccagactaacttcccgaaggaccgtccccggaccccccgtactccctctactactaataagaaatgactcacgtccggccccgtccggggtccctacggaccgtacttcctcgtcggtcctcctagttcgtccgtcggcctaccctcacgtccctcctacgtaacttactcgtacgggtcgggtccgttcccggggtaccggaggtacgtacggacggtcttagtaatttacgttacgtggttcgaccgtacgggtaggacgtgactacgtccgtaggtaacgtcgggtccgggttgggttccggggcgggaacggaccgacgggtcgtacggacccgttacgtaacgtcgaaccggacccgaacggtcccgtacccggtccccgtcgg

SEQ ID NO: 411477 - DNA, 580 bp, Homo sapiens
  misc_feature: GZ8MTXP02HR7SG.17.28.C06.1.454.CMB.2.raw
  modified_base (384)..(384): a, c, t, g, unknown or other
  modified_base (425)..(425): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagccgtgggggtccctgagactctcctgtgcagccctccggattcccctcagtagttattggatgacttgggtccgccagactccgaggggaaggggctggagtggatcgggaccaaacataaaagcaaagatggaactgccgtagtttttacgnggtactctgtggaagggtccgtttcaccgtatcctccaganacaacgccaaagattcactgtatctacaactgaaacagcctagagagtcgcagacacggcgtgttattacgtgtgcgagagtagtaagggaaaaacgtagtaggtcttaggttggtttaagtgggggtacccaggggacgtcccgttaggtcccg

SEQ ID NO: 411478 - DNA, 560 bp, Homo sapiens
  misc_feature: GZ8MTXP02GQJUV.17.28.C06.1.454.CMB.2.raw
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggcagaggtcaccatatcttgttctaggaaacagctccggcatctacaactaactattttgctggtaccagcaattccccaggactcccggccccccgactcctcatctatagaaatgatcagtccggccctccggggtcctgaccccgtatctctggctccatcgtctggccacctcacgccctccctcgaccatcacgtcgggccgtccggtccgaggatggagctagtattattactgtgcgtaccgtggatgacatcctagtagtcggtcggtggttcgggcgggacgggaccgacggtcgtacggacccgtaaccgtaacgtccgacggcccgaacggtcctccgcccccg

SEQ ID NO: 411479 - DNA, 575 bp, Homo sapiens
  misc_feature: GZ8MTXP02H9SGZ.17.28.C06.1.454.CMB.2.raw
  modified_base (233)..(233): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggaccccggcagaggtcaccatatcttgtctggaaacngctccggcatctcaactaactattttgctggtaccagcaattccccaggactcccggccccccgactcctcatctatagaaaatgatcatccggcccctccggggtcctgaccccgattcctctggctccatgtctggcctaccctcacgccctccctgaccatccgagtcgggccttcccggccgaggatggagtctagtatttacttactgtagcgtaccggtgggatcgactactccgtagaagttcggggttccggtggttccggggcgggtaacggggacctagggcctcggaacccgtcgtaaacggtcacggcccgaacggtcctccggcccccg

SEQ ID NO: 411480 - DNA, 677 bp, Homo sapiens
  misc_feature: GZ8MTXP02J54R5.17.28.C06.1.454.CMB.2.raw
  modified_base (205)..(205): a, c, t, g, unknown or other
  modified_base (235)..(235): a, c, t, g, unknown or other
  modified_base (244)..(244): a, c, t, g, unknown or other
  modified_base (265)..(265): a, c, t, g, unknown or other
  modified_base (437)..(437): a, c, t, g, unknown or other
tcagcgtagactagcacgaccggtgctcgatttagagctcacgtattgggtttgggcagcttcagctgtggtagagaagacaggattcaggacaatctccagcatggccggcttccctctcctcctcaccctcctcactcactgtgcagggtcctgggcccagtctgtgctgactcagccacctcagtgtcgtcggaccccgggnagaggtcaccatatcttgttcaggaaaccncgcgtccgntactacctactaacttaactnttacgcgtacgtaccacgactactccgacggaccgtccccggccccgtacctcctactacttacgtaataagtaactcgactccgtaccgttcccgggtccccggttcccgggtcccgtacggtaccccgtacttccgtcgtcgtcctccgtatcgtcgtcgacctcctccnccgtcctccctccgtaccgtacgtacgtacggtcgggtccggtccgggtaccggtacggtagtaggtagtcgtagttattacgttacgttcgtcgtacggtacggtacggtacggtacgtacgtacgtacgtacgtacggtcggttcggttcgggtcggtacggtacgggtacggtaccgtaccgtaccgtaccgtaaccgtaccgtaccgtaccgtaccgtaccgtaccgtccgtcccg

SEQ ID NO: 411481 - DNA, 576 bp, Homo sapiens
  misc_feature: GZ8MTXP02F5JI4.17.28.C06.1.454.CMB.2.raw
  modified_base (376)..(376): a, c, t, g, unknown or other
  modified_base (495)..(495): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagcctggtccagcctgggggtcctgagactctcctgtgcagcctctggacttccccttcagttagttattggatgacgttgggtccgccagactccgaggggaaggggctggagtgggtggccaacataaagcaaagataggaactgccgtagtttacgnggactcgtgtgaagggccgtttcaccatctccagagacaaacgcaaagattcactgtatctaacaactgaaacagcctgagagtcggacagacgacggcgtagtattacgtgtgacganagttacggtaaaggaaaaaagtagtgggacttggttaagttttaaggttcgggggacctaggggacgtcccgtggtacccg

SEQ ID NO: 411482 - DNA, 556 bp, Homo sapiens
  misc_feature: GZ8MTXP02JDRWL.17.28.C06.1.454.CMB.2.raw
  modified_base (378)..(378): a, c, t, g, unknown or other
  modified_base (539)..(539): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctgggggtccctgagactctcctgtgcagcctccggattccccttcagtagttattggatgacttgggtccgccagactccgagggaaggggctggagtgggtggccaacataaagcaaagatggaactgccccgtagtttacgnggactctgtgagggcctttcaccatctcagagacacgccaagaattcactgtatctaacaactgaacagcctgagagtcgcagacacggcgtgtatacgtgtgcgagatggtaaggaaaaagtagtggtctggttagtttaagtgggggaccagggggacncccgttggtcctacccg

SEQ ID NO: 411483 - DNA, 588 bp, Homo sapiens
  misc_feature: GZ8MTXP02HB5A0.17.28.C06.1.454.CMB.2.raw
  modified_base (237)..(237): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccattctgtgctgactcagccaccctcagtgtctcgggacccccggcagagggtcaccatatcttgttctggaaacngctccggcatctacaactaaactattttgctggtaccagcaattccccaggactccggcccccgactcctcatctaatagaaatgactcagtccggcccgtccggggtccctgaccccgattcctctggctccatcgtctggccacctcacgcctccctgaccatcaggtcggcctccggtccgaggatgaggctagatttatacgtgtcgcgtaccggtgggactacggactacgttccgtagtaacgttcgggttaccggtggttcgggacgggtacgggaccgagggtcctacggacccgtaaccgtaaacgtccgacgacccgaacgggtcccttaccggccccccg

SEQ ID NO: 411484 - DNA, 508 bp, Homo sapiens
  misc_feature: GZ8MTXP02I4Q4P.17.28.C06.1.454.CMB.2.raw
  modified_base (363)..(363): a, c, t, g, unknown or other
  modified_base (495)..(495): a, c, t, g, unknown or other
  modified_base (499)..(508): a, c, t, g, unknown or other
tcagcgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatccggcccccgactcctcatctatagaaatgatcatcggccctcgggtccctgaccgattctctggctccatgtctggcacctcagccctcccctgacccatcagtgggctccggtccgaggatgaggctgattattactgtgcacgtggatgacntcctgatggtccgtgtcggcggagggccaggctgaccgtctaagtcagcccaaggctcgccccctcggtcacgtcctcgttccccgccctcctcctacgtcctacgcctgagcgggctgggccaaggcgcanacgnnnnnnnnnn

SEQ ID NO: 411485 - DNA, 557 bp, Homo sapiens
  misc_feature: GZ8MTXP02HOUMI.17.28.C06.1.454.CMB.2.raw
  modified_base (465)..(465): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagccgtgggggtccctgagactctcctgtgcagccctccggattcccccttcagtagttattggatgacttgggtccgccagactccaggggaaggggctgggagtgggtggccaacataaaagcaaagatggaaactgccccgtagtttacgtggactctgtgaggggtcctttcaccatctcagagacacgccaagaattcactgtatctaacaactgaacagcctgagatcgnagacacggtcgtgtaattacctgtgcgagagtagtaggaaaagtaaatagacgtgtgttaagttgggtcggtaggagccgtcgtcgtacccg

SEQ ID NO: 411486 - DNA, 548 bp, Homo sapiens
  misc_feature: GZ8MTXP02JVQEA.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctggggggtccctgagactctcctgtgcagcctccggattccccttcagtagttattggatgacttgggtccgccagactccagggaaggggctggagtggggtggccaaacataaagcaaagatggaactgccccgagtttacgtggactctgtgagggccgtttcaccatctccagagacaacgccaagaattcactgtatctacaactgaacagcctgagagtcgcagacacggccgtgtattactgtgcgagatgaggaaaaagtatggctgtgtttaagttggggaccaggggacgcccgtggtcctaccg

SEQ ID NO: 411487 - DNA, 581 bp, Homo sapiens
  misc_feature: GZ8MTXP02FS8EX.17.28.C06.1.454.CMB.2.raw
  modified_base (374)..(374): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattccccttcagtagttatggatgacttgggtccgccagactccagggaggggctggagtgggtgccaaacataaagcaaagatggaaactgccccgagttttacgnggactctgtgaggggccgtttcaccatctcagagaacaacgccaaagaattcaactgtaatctaacaactagaaacagcctagagagtcgacagaaccacggccgtagttaattaccgtgtgcgaagataggtaggaaaaaaacgtatgggacttggttagtttaagttgggggaccaagggggacgtccctggggtcctaccccgg

SEQ ID NO: 411488 - DNA, 552 bp, Homo sapiens
  misc_feature: GZ8MTXP02HG0VH.17.28.C06.1.454.CMB.2.raw
  modified_base (373)..(373): a, c, t, g, unknown or other
  modified_base (409)..(409): a, c, t, g, unknown or other
  modified_base (508)..(508): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagctggtccagcctgggggtcctgagactctcctgtgcagcctccggattccccttcagtagttattggatgacttgggtccgccagactccgagggaaggggctggagtgggtggccaacataaagcaaagatggaactgccccgtagtttacgnggactctgtgaggggtcctttcaccatcctccaganacaacgccaaagaattcaacttgtatctaacaactgaaacagcctgagagtcgcagacacggccgtgtaattactgtgacgagatggtagaaaaagtanggctgtgtttaagtggggacctagggacgccgtggtactacccg

SEQ ID NO: 411489 - DNA, 554 bp, Homo sapiens
  misc_feature: GZ8MTXP02JTA1R.17.28.C06.1.454.CMB.2.raw
  modified_base (371)..(371): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagcctggtccagcctggggggtccctgagactctcctgtgcagccctccggattccccttcagtagttatggatgacttgggtccgccagactccgaggggaaggggctgggagtgggtggccaacataaagcaagatggaactgccgtagtttacgngactctgtgaagggtccgtttcacctatctccaagacgacaacgccaaagaattcactgtatctacaactgaacagcctgagagtcgcagacacggccgtgtatactgtcgcgagatggaggaaaaacgtagtggacttggtagtttaggttggggccaggggacgccgtggtaccaccgtcc

SEQ ID NO: 411490 - DNA, 559 bp, Homo sapiens
  misc_feature: GZ8MTXP02JAM8E.17.28.C06.1.454.CMB.2.raw
  modified_base (372)..(372): a, c, t, g, unknown or other
  modified_base (394)..(394): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctgggggtccctgagactctcctgtgcagcctccggattccccttcagtagttatggatgacttgggtccgccagactccaggggaaggggctggagtggggtggccaaacataaaagcaagatggaactgccgagttttacgnggactctgtgaagggccgtttnaccatctccagagacaacgccaaagaattcactgtatcctaacaactgaaacagcctgagagtcgcagacacggccgtgtatactgtgcgagatggtaaggaaaaagtaagtcggctagtgttttaagttgggggaccaggggtacgcccgtgggtccacgttcc

SEQ ID NO: 411491 - DNA, 607 bp, Homo sapiens
  misc_feature: GZ8MTXP02H3QJA.17.28.C06.1.454.CMB.2.raw
  modified_base (238)..(238): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcacccctcctcactcactgtgcagggtcctgggcccagtctgtgctgactcagcccaccctcagtgtcgtcgggaccccggcagaggtcaccatatcttgttctggaaacngctccggcatctcaactaaactattttgctggtaccagcaacttcccaggactccccggccccccgactcctcatctaatagaaatgatcactccggccccgtccggggtcctcgaccccgtattcctctcggtcctacccattcgtcgtacggcctaccctcacgcccttcccctagacccagtcgacggtcggggcccttccgggtccgaggatggacgctagatttactacgttgcgcgtaccggtgggatcgacacttccgagtaacgttcggtccgggtggttaccgggcggtacgggaccacggctacggacccgtaaccgttaaacgccgaaccgcccgaaacgggtcctcccggtcccccg

SEQ ID NO: 411492 - DNA, 582 bp, Homo sapiens
  misc_feature: GZ8MTXP02IB0RV.17.28.C06.1.454.CMB.2.raw
  modified_base (381)..(381): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagccgtgggggtccctgagactctcctgtgcagcctccggattccccttcagtagttattggatgacttggtccgccagactccgaggggaaggggctggaggtgggtggccaacataaagcaaagatggaaactgccccgtagttttacgnggactctgtgagggtccgtttcacctatcctccagacgacaacgaccaaagattcacttgtatctaacaactgaacagcctgagagtcgcagacgacggccgtagtattactgtgcgagagtggtaaagtaaaaaggtatacggcttagttagtttaaggttcggggaccgtaggggacgtccccgtagggttccacccgg

SEQ ID NO: 411493 - DNA, 559 bp, Homo sapiens
  misc_feature: GZ8MTXP02GYX0Z.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattccccttcagtagttattggatgacttggtccgccagactccagggaaggggctggagtggggtggccaacataaagcaaagatggaactgccccgagtttacgtggactctgtgaggggtccgtttcaccatctccagagacaacgccaaagaattcactgtatctacaactgaacagcctagagagtcgacagaccacggccgtgtattactgtgcgagatagtaggaaaaagtagtggacttgtgtttaagttggggaccgagggtacgcccttgggacctacccgg

SEQ ID NO: 411494 - DNA, 589 bp, Homo sapiens
  misc_feature: GZ8MTXP02IYQYE.17.28.C06.1.454.CMB.2.raw
  modified_base (206)..(206): a, c, t, g, unknown or other
  modified_base (234)..(234): a, c, t, g, unknown or other
  modified_base (242)..(242): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggnagaggtcaccatatcttgtctggaaacngctccggnatctcaactaaactattttgctggtaccagcaattcccaggactccggccccccgactcctcatctaatagaaatgatcatccggcccgtccggggtccctggaccccgtattcctctcggctccgatcgtctggccaccgtcacgtccctccctacgacccactccgaggtcgggccgtcccggtccgaggagtgagctagtattattacgtgtcgcgtaccgtggatagacactcctagtacgtcggtccggttcggttccggggcggtaacgggaccgtacgggacgtcggtacccgtaaccgtaacgtaccgacgacccgaaacggtccgtaccgtcccccgg

SEQ ID NO: 411495 - DNA, 557 bp, Homo sapiens
  misc_feature: GZ8MTXP02HU7XA.17.28.C06.1.454.CMB.2.raw
  modified_base (235)..(235): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggcagagggtcaccatatcttgttctggaaacngctccggcatctcaactaaacattttgctggtaccagcaaattcccaggatcggcccccgactcctcatctatagaaatgatcatcggccctccggggtccctgaccgacttctctgctccatgtctggcacctcagccctccctgaccatcagttggcctccggtccgaggatgaggtctagatttattactgttgcctaccggtgggatgactatcctgaagtcgggtcccgtggttcgggcgggaacgggaccacgggtccttacggacccgttccgtaaacggtccaacggaccccaagggccctcggcccccctcgg

SEQ ID NO: 411496 - DNA, 502 bp, Homo sapiens
  misc_feature: GZ8MTXP02JG7FA.17.28.C06.1.454.CMB.2.raw
  modified_base (360)..(360): a, c, t, g, unknown or other
  modified_base (487)..(487): a, c, t, g, unknown or other
  modified_base (494)..(502): a, c, t, g, unknown or other
tcagcgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgatcctcatctatagaaatgatcatcggccctcgggtccctgaccgattctctggctccatgtctggcacctcagcctccctgaccatcagtgggctccggtcgaggatgaggctgattattactgtgcaccgtgggatgacntcctgaatgggtccgtgttcggcgggaggaccaggctgaccgtcctaagtcagcccaaggctcgccccctggtcacgtcctcgttcccaccctcctcctagtctacgctgagcggctggcaagggcncatacgnnnnnnnnn

SEQ ID NO: 411497 - DNA, 546 bp, Homo sapiens
  misc_feature: GZ8MTXP02F8F5C.17.28.C06.1.454.CMB.2.raw
  modified_base (379)..(379): a, c, t, g, unknown or other
  modified_base (483)..(483): a, c, t, g, unknown or other
  modified_base (533)..(533): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctgggggtccctgagactctcctgtgcagcctccggattccccttcagtagttattggatgacttgggtccgccagactccagggaaggggctggagtgggtggccaacataaagcaaagatggaaactgccccgtagttttacgnggactctgtgaggggccgtttcaccatctccagagacaacgccaagaattcactgtatctaacaactgaacagcctgagagtcgacagacacggctgtattacngtgcgagatggtagaaaagtatggctgtagttaagtggggccaggggacnccgtggtctaccg

SEQ ID NO: 411498 - DNA, 618 bp, Homo sapiens
  misc_feature: GZ8MTXP02I0VVJ.17.28.C06.1.454.CMB.2.raw
  modified_base (377)..(377): a, c, t, g, unknown or other
  modified_base (403)..(403): a, c, t, g, unknown or other
  modified_base (408)..(408): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctgggggtccctgagactctcctgtgcagcctccggattccccttcagtagttattggatgacttgggtccgccagactccagggaaggggctggagtggggtggccaacataaagcaaagatggaaactgccccgagtttacgnggactctgtgagggtcgttcacatcncaganacaacgccaagaatcactgtatctaacaactgaacagcctagagagtcgcaagaccgacggccgtggtaacttacgtggtcgacgtaaggtattagggtaaagggtaaaaaaagttaagtcggggtaactttgggtttaggttttaagggttcgggggtaacccgaaggggggtaaccgtcccccggtttggggtaccgttaacccccgg

SEQ ID NO: 411499 - DNA, 566 bp, Homo sapiens
  misc_feature: GZ8MTXP02GSVNV.17.28.C06.1.454.CMB.2.raw
  modified_base (346)..(346): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggcagagggtcaccatatcttgttctggaaacagctccggcatctacaaactaaactattttgctggtaccagcaattcccaggactccggccccccactcctcatctatagaaatgatcatccggcccgtccggggtcccngaccgacttctctcgctccatgtctcgctacctcacgccctcctcgaccatcacgtgggccctccggtccgagagtggagctagtattatacgtgtgctaccggtgggactggacagtcctgtaacgtgggtccggttggttccgggacgggacgggaccgacggctacggacccgtacgtaaacgtccgaacgcccgaacggcctccggcccccgtcgg

SEQ ID NO: 411500 - DNA, 555 bp, Homo sapiens
  misc_feature: GZ8MTXP02IS46Y.17.28.C06.1.454.CMB.2.raw
  modified_base (374)..(374): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctgggggtccctgagactctcctgtgcagcctccggattcccctcagtagttattggatgacttgggtccgccagactccagggaaggggctggagtgggtggccaacataaagcaaagatggaactgcccgagttttacgnggactctgtgaggggtccgtttcaccatctccagacacaacgccaaagaattcactgtatctaacaactgaaacagcctgagtagtcgcaagacacggccgtgtattactgtgcgagatgtaggaaaaagtatcggctgttgttaagttggggacctaggggacgcccgtaggtctaccgg

SEQ ID NO: 411501 - DNA, 594 bp, Homo sapiens
  misc_feature: GZ8MTXP02HB8A5.17.28.C06.1.454.CMB.2.raw
  modified_base (375)..(375): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattccccttcagtagttattggatgacttgggtccgccagactccgaggggaggggctggagtgggtggccaacataaagcaagatggaactgccccgtagtttacgngactctgtgacggggtccgtttcacctatcctccagagaacaacgaccaaagaacttcactgtactactaacaactagaacagcctagagagtcgacagacaccggccgtagtattacgtgtgcgagtagtaggtaaggaaaaagtagtacggtacttaggtttaggtttaaggttcgggggaccgagggggtacgtccccgttagggtccctacccgg

SEQ ID NO: 411502 - DNA, 535 bp, Homo sapiens
  misc_feature: GZ8MTXP02IZYB7.17.28.C06.1.454.CMB.2.raw
  modified_base (237)..(237): a, c, t, g, unknown or other
  modified_base (245)..(245): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtctgggacccccggcagagggtcaccatatcttgttctggaaacngctccggnatctcaactaaacattttgctggtaccagcaattccccaggactccggccccccgactcctcatctaatagaaaatgaatcatccggccctccggggtcctgaccccgattctctggctccatgtctggcacctcagcctcctgccatcaggtgggctcggtccgaggatcgagctgattatactgtgcaccggtggatgacatccgtagacgtggtccggtggttcggcgggtagggaccacggcctcgaccggtcctaagtcacggcccaagggccctcggtcccccg

SEQ ID NO: 411503 - DNA, 520 bp, Homo sapiens
  misc_feature: GZ8MTXP02H7K1W.17.28.C06.1.454.CMB.2.raw
  modified_base (383)..(383): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcacccctcctcactcactgtgcagggtcctgggcccagtctgtgctgactcagccaccctcagtgtctgggacccccggcagagggtcaccatatcttgttctggaaacagctccggcatctcaactaaacattttgctggtaccagcaattcccaggatccggcccccgactcctcatctatagaaaatgatcatcggccctccggggtccctgaccccgattctctggctccatgtctgcacctcagcctcccngaccatcagtgggctccggtccgaggatgaggctgatttattactgtgcaccgtgggatgacatcctgaatggtccgtgttcggcggagggaccagggctggaccgtccgtaagtcacggcccaggcctcgcccccg

SEQ ID NO: 411504 - DNA, 578 bp, Homo sapiens
  misc_feature: GZ8MTXP02GMN3S.17.28.C06.1.454.CMB.2.raw
  modified_base (380)..(380): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctgggggtccctgagactctcctgtgcagccctccggattccccttcagtagttattggatgacttgggtccgccagactccgagggaaggggctggagtgggtggccaacataaagcaaagatggaaactgccccgtagttttacgnggactctgtgaggggtccgtttcaccatctccagagacaacgccaagatcactgtatctaacaactagaacagcctagagagtcgacgagaccgacggtccgtagtacttactgtgtcgagtagtggtaagaaaaagtagtaggtcgtaggttgtttaagttcggggaccgtaggggacgcccgttgggtactacccg

SEQ ID NO: 411505 - DNA, 565 bp, Homo sapiens
  misc_feature: GZ8MTXP02IA9OX.17.28.C06.1.454.CMB.2.raw
  modified_base (205)..(205): a, c, t, g, unknown or other
  modified_base (235)..(235): a, c, t, g, unknown or other
  modified_base (410)..(410): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggnagagggtcaccatatcttgttctggaaacngctccggcatctcaactaaactatttttgctggtaccagcaattcccaggatccggccccccgatccctcatctatagaatgatcatcggccctccggggtccctgaccgatctctggctcatgtctgcacctcacgccctcctcgacccatcagtcgggcctccggtccgaggntgaggctgattattactgtgcgaccggtggatgactatcctagaacgtcggtccgggttggttccgggacggggacgggaccgacggtccgtacggtaacccggtccgtaaacggtccaacgaccccgaacggtcccgtaccgtcccccgtccgg

SEQ ID NO: 411506 - DNA, 624 bp, Homo sapiens
  misc_feature: GZ8MTXP02HL9GA.17.28.C06.1.454.CMB.2.raw
  modified_base (236)..(236): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacngctccggcatctacaactaaactattttgctggtaccagcaattcccaggactccggccccccgactccctcactctataagaaatgatcactccggtccctccggggtcctggaccgacttcctcgtggcctcagttcgtctcggctacctcacgtccctccctgacccatccgaggtcgggccgttcccgggtaccgaggacgtggacggcgtagtattattacgtcgttgccgacgggtaggactgacacgtcctggtaacgttcggggtcccggttgggttaccggggacgggtacggggaccgacgggacgtaccggaacccggttacccgtaaaggtccgaacggacccgaaacgggtcccgtcccggtcccccgttacggg

SEQ ID NO: 411507 - DNA, 592 bp, Homo sapiens
  misc_feature: GZ8MTXP02G16WQ.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtggggggtccctgagactctcctgtgcagcctccggattccccttcagtagttattggatgacttgggtcccgccagactccgagggaaggggctggagtgggtggccaacataaagcaaagatggaaactgaccccgtagtttacgtggactctgtgaggggtccgtttcaccagtcctccagacgacaacgaccaaagaattcactgtactctacaactgaacagcctagagagtcgcaagaccacgggccgtagtattactgtgcgaagagtaggtaaggtaaaaagtaagtggacttggttaggtttaagttgggggacccgtagggggacgtcccgttgggtacctacccgg

SEQ ID NO: 411508 - DNA, 569 bp, Homo sapiens
  misc_feature: GZ8MTXP02HG54X.17.28.C06.1.454.CMB.2.raw
  modified_base (235)..(235): a, c, t, g, unknown or other
  modified_base (472)..(472): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggcagagggtcaccatatcttgtctggaaacngctccggcatctcaactaaacattttgctggtaccagcaattcccaggactccggccccccgactcctcatctatagaaatgatcatcggccctccggggtccctgaccccgtatctctggctccatcgtctggccacctcacgccctccctcgaccatcgacgtcgggccgtccggtcccgaggagtcggacgctagtagtttacttacgttgtcgccgaccgtgggagtgaactntccgtagaagttcgggtccggtggttcgggcgggacgggacgacggcgtacggaccgtcgtaacgccgacgacccgtaacggccttaccggcccccg

SEQ ID NO: 411509 - DNA, 678 bp, Homo sapiens
  misc_feature: GZ8MTXP02GJQQ9.17.28.C06.1.454.CMB.2.raw
  modified_base (239)..(239): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggcaggagggtcaccatatcttgttctggaaacngctccggcatctacaaactaaactatttttgctggtaccagacaacttcccaggactcccggccccccgactcctcatctatagaaatgatcacgtccggccccgtccggggtccctcgaccccgtattcctctcggcctccatcgtctcggcctaccctcacgtccctccctacgacctatcgaggtcgggccctcccgggtccgaggagtcggacggtcttaggtaatttacgttaccgttggtcgtaccgtacccgggtagggtactcggaacctacgttcccgtaagggtaacggttccgggggttacccggggtttcgggttaccgggggaccggggtaaacggggtacccggacgggtccgtaccgggtaacccgttaaccgtaaacggtccgaaccggaccccgaaacggggtccctaccccggtcccccgg

SEQ ID NO: 411510 - DNA, 568 bp, Homo sapiens
  misc_feature: GZ8MTXP02HTU17.17.28.C06.1.454.CMB.2.raw
  modified_base (374)..(374): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtcagcctgggggtcctgagactctcctgtgcagcctccggattccccttcagtagttattggatgacttgggtccgccagactccgagggaaggggctggagtggggtggccaacataaagcaaagatggaactgcccgtagtttacgnggactctgtgaggggtcctttcaccgatcctacagagacaaacgccaagaacttcactagtatctaacaactgaaacagcctgagagtcgacacgacacggcctgtacttactgtgcgagataggaaggaaaaagttatggacttgttagtttaacgttgggggacctaggggactcccgtgggtacctacccg

SEQ ID NO: 411511 - DNA, 642 bp, Homo sapiens
  misc_feature: GZ8MTXP02H3F4T.17.28.C06.1.454.CMB.2.raw
  modified_base (276)..(276): a, c, t, g, unknown or other
  modified_base (379)..(379): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggagcctggtcagccgtgggggtcctgagactctcctgtgcagcctccggattcccctnagtagttattggatgacgttggtccgccagactccgaggggaaggggctggaggtgggtggaccaacataaagcaaagatggaactgccccgtagttttacgnggactcgtgtgaggggtcctttcaccatcctcagagacaacgccaagaacttcaacttagtactctaacaaactcgaaaactggtaccctaggaagtacggtaccgacaaggaacccgacgggtcccgttagtaatttaccgtggtacgacggtaagagttagggtaaacggtaaaaaagtacgttgggtactttggttaagttttaacgggttacgggggaccgtaaagggggaccgtccccgttggggttacccaacccgg

SEQ ID NO: 411512 - DNA, 625 bp, Homo sapiens
  misc_feature: GZ8MTXP02IJIP2.17.28.C06.1.454.CMB.2.raw
  modified_base (377)..(377): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctgggggtccctgagactctcctgtgcagcctccggattccccttcagtagttattggatgacttgggtccgcagactccgagggaaggggctggagtgggtgtcaacataaagcaagatggaaactgccccgtagttttacgngactctgtgaggggtcctttcaccatctcagacgacacgccaaagatcactgtatctacaactagaacagcctagagtagtcgacaacgaccgaacgggtccgttaggttaactttacgtggtacgacgtaagtagttaggtaaagggtaaaaaaagttaacgttgggtacgtttaggtttagggttttaaaggttcgggggtaccctagggggtaaccgtcccccgttggggtaccctaaccccggg

SEQ ID NO: 411513 - DNA, 507 bp, Homo sapiens
  misc_feature: GZ8MTXP02F8VJS.17.28.C06.1.454.CMB.2.raw
  modified_base (499)..(507): a, c, t, g, unknown or other
tcagcgtagactagcacgaccggtgctcgatttagagctcacgtattgggtttgggggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatccggccccccgactcctcatctatagaaatgatcatcggccctccggggtccctgaccgattctctggctccatgtctggcacctcagccctccctgaccatcagtcggctccggtcgaggatgaggctgattatactgtcgcaccgtggatgacatcctgaatggtccgtgttcgggcggagggaccaggctgaccgtctaagtcacgcccaaggcctcgccccctcggtcacgtctcgttccccgccctcctcctagtcctacgctgacgcggctcggcaggcgacatgnnnnnnnnn

SEQ ID NO: 411514 - DNA, 745 bp, Homo sapiens
  misc_feature: GZ8MTXP02GIQCO.17.28.C06.1.454.CMB.2.raw
  modified_base (212)..(212): a, c, t, g, unknown or other
  modified_base (242)..(242): a, c, t, g, unknown or other
  modified_base (265)..(265): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcacgcccaccctcagtcgtcgtcggggacccccggnaggaggtcaccatatcttgtctaggaaacngcctcggcatctacaactaactntttgctggtaccagtactaacttcccgaggtacctccccggaccccctactcctactactactaataaagtaaatcggaactccgtaccggtccccgggtacccccggttccccggggtccctacggtaaccccccgttacttccgttcggtacggtccctacccgtaagttccggttccgtcgggtacccctaccccttccgaacccgtcccccttacccccgacgtaaaccctacgtccggtacggggtccgggtccccgttaccccgggggtaccggaagggtacgttgggaaccggttacgtttacgttaacgtttacgttacggtcggtaccggtaccggtaccggtaggtactacgtactacgtcgtaggtacggttcgggtcgggtcggtcggggacggtacggaccgtacggtccgtaccggtaccgtaacgtacgaccgaccggtaccgtacggtcccgtaccccgtcccg

SEQ ID NO: 411515 - DNA, 585 bp, Homo sapiens
  misc_feature: GZ8MTXP02GX3R0.17.28.C06.1.454.CMB.2.raw
  modified_base (375)..(375): a, c, t, g, unknown or other
  modified_base (564)..(564): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattccccttcagtagttattggatgacttgggtccgccagactccaggggaaggggctggaggtgggtggccaacataaagcaagatggaactgcccgtagtttacgnggactctgtgaggggtccgtttcaccatcctcagagacaacgccaaagaattcactgtactctaacaactcgaacagccctagacgagtcgcagaccgacggccgtgtaattactgtgcgagtagtaggtaaggaaaaagttaagtcggacgttgttagtttaaggttcgggggaccgtagggggaccncccggttggtaccctacccgg

SEQ ID NO: 411516 - DNA, 514 bp, Homo sapiens
  misc_feature: GZ8MTXP02HZ72C.17.28.C06.1.454.CMB.2.raw
  modified_base (237)..(237): a, c, t, g, unknown or other
  modified_base (449)..(449): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacngctccggcatctcaactaaacattttgctggtaccagcaattccccaggactccggccccccgactcctcatctatagaaatgatcatcggccctccggggtcctgacccgattctctggctccatgtctggccacctcacgcctccctgaccatcagtggctccggtcgaggactgagctgattattactgtgcaccgtggatgacatccngaatcggtccggtgttcggcggagggaccaggctgaccgtcgagtcacgccacggctcggccccc

SEQ ID NO: 411517 - DNA, 512 bp, Homo sapiens
  misc_feature: GZ8MTXP02I32E3.17.28.C06.1.454.CMB.2.raw
  modified_base (205)..(205): a, c, t, g, unknown or other
  modified_base (235)..(235): a, c, t, g, unknown or other
  modified_base (243)..(243): a, c, t, g, unknown or other
  modified_base (403)..(403): a, c, t, g, unknown or other
  modified_base (423)..(423): a, c, t, g, unknown or other
  modified_base (426)..(426): a, c, t, g, unknown or other
  modified_base (440)..(440): a, c, t, g, unknown or other
  modified_base (443)..(443): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggnagagggtcaccatatcttgttctggaaacngctccggnatctcaactaaacattttgctggtaccagcaattcccaggatccggccccccgactcctcatctatagaaatgatcatcggccctccggggtccctgaccgattctctggctccatgtctgcacctcagcctccctgacccatccagtgggctccggtcnggatgaggctgattattacngtncacgtggatgactntcngagtggtcgtgtcggacggacggacaggctacgaccgtacgtaagcgacgaccgagcctccgcccgtcg

SEQ ID NO: 411518 - DNA, 626 bp, Homo sapiens
  misc_feature: GZ8MTXP02HCOHF.17.28.C06.1.454.CMB.2.raw
  modified_base (236)..(236): a, c, t, g, unknown or other
  modified_base (257)..(257): a, c, t, g, unknown or other
  modified_base (269)..(269): a, c, t, g, unknown or other
  modified_base (279)..(279): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacngctcgcatctacaactaactntttgctgtacancactccagcnccgccccactcctcatactaataagaatgactcacgtccggccccgtccgggtccctacgtaccgtcttctcgtcgtcctctagtcgtcgtcgcctacctccgaccgtccctccctacgaccctactccgtacgggtcgggtcccgtcccgggtacgaggtacgtcggacggtacttagttaactttacgttacgtcggtacgaccgtacgggtggtactacgactacgtcgtaggtacgttcggggtccgggttcgggtacggggacgggtaccgggaccgacggtccgtaccggtaccgtacgtaacgtccgaccggtaccgacggtccgtcccggtccccgtcg

SEQ ID NO: 411519 - DNA, 564 bp, Homo sapiens
  misc_feature: GZ8MTXP02GA4ZI.17.28.C06.1.454.CMB.2.raw
  modified_base (375)..(375): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgttgctgttttagaaggtgtccagtgtgaggtccagttggtgagtccggggagcctggtccagcctgggggtccctgagactctcctgtgcagcctccggattccccttcagtagttattggatgacttgggtccaccagactccgagggaaggggctggagtgggtggccaacataaagcaaagatggaaactgcccgtagttttacgnggactctgtgagggcctttcaccatctcagagacaacgccaaagaattcactgtatctaacaactgaacagcctagagagtcgacaagaccacgggccgtgtaattactgtgcgagataggtaaggaaaaagtatgggactggttagtttaagtgggggacctagggggactccccgtgggtcacccgg

SEQ ID NO: 411520 - DNA, 659 bp, Homo sapiens
  misc_feature: GZ8MTXP02JYCFC.17.28.C06.1.454.CMB.2.raw
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaactatttttgctggtaccagcaattcccaggactccggccccccgatccctcatctatagaaatgatcatcggccctccggggtccctgaccgtacttctctcggctccatgtctcggcacctcacgccctccctgacccatcgagtcgggtccgtcccggtcgaggactggacggcttgatttattacgtgtagcgaccgggttagggacttaggactacgttacccgtaggtaacgttcggggtacccggggttgggtttcccgggggacggggtaacgggggtaccccggaaggggtcccgtaccgggttaaccccggttacccgttaaaaggttcccggaaccggacccccggttaaacggggcccccgtttccccgggaccccccggttttacccgggg

SEQ ID NO: 411521 - DNA, 594 bp, Homo sapiens
  misc_feature: GZ8MTXP02ICTME.17.28.C06.1.454.CMB.2.raw
  modified_base (278)..(278): a, c, t, g, unknown or other
  modified_base (379)..(379): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggttgagtccgggggagcctggtccagccgtgggggtccctgagactctcctgtgcagcctccggattccccttnagtagttattggatgacttgggtccgccagactccgaggggaaggggctggagtgggtggaccaacataaagcaagatggaactgccccgtagttttacgnggactctgtgaggggtccgtttcacctatcctcagacgacaacgaccaaagattacacttgtatactaacaactgaaacagcctagagagtcgacagacgcggaccgtgtattactgtagcgtagagttaggtaaagaaaaagtagtacggtacgttagttaggtttaaggtttcggggaccggaggggacggtcccgttcgggtacctacccgg

SEQ ID NO: 411522 - DNA, 558 bp, Homo sapiens
  misc_feature: GZ8MTXP02GVRX9.17.28.C06.1.454.CMB.2.raw
  modified_base (374)..(374): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctgggggtccctgagactctcctgtgcagcctccggattccccttcagtagttatggatgacttggtccgcagactccgagggaaggggctggagtgggtggccaacataaagcaaagatggaaactgccccgagtttacgnggactctgtgagggccgtttcaccgtatctccagagaacaacgccaaagaattcaactgtatctacaactgaacagcctgacgagtcgcagacacggccgtgtattactgtgcgagagtgtacgaaaaagtataggactggttgtttaagttggggaccgagggacgtcccgtcggtcacccgg

SEQ ID NO: 411523 - DNA, 583 bp, Homo sapiens
  misc_feature: GZ8MTXP02IA4ZR.17.28.C06.1.454.CMB.2.raw
  modified_base (343)..(343): a, c, t, g, unknown or other
  modified_base (380)..(380): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcttgttgctgttttagaaggtgtccagtgtgaggtccagttggttgagtcggggagcctggtcagcctgggggtcctgagactctcctgtgcagcctccggacttccccttcagtagttattggatgacttgggtccgccagacctccgaggggaaggggctgggaggtggggtggccaanataaaagcaaagatggaactgccccgtagttttacgnggactctgtgaggtccgtttacacctatctccagacgacaacgaccaaagtaattcaacttgtactctaacaactcgaacagacctgagagtcgacagacgaccggcgtgtattacgtgtgcgagagtaggaagtaaaaagtagtaggacttgttagtttaaggttcggggaccgtaggggacgtcccggtggtacctacccg

SEQ ID NO: 411524 - DNA, 597 bp, Homo sapiens
  misc_feature: GZ8MTXP02FPIDN.17.28.C06.1.454.CMB.2.raw
  modified_base (383)..(383): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtggggggtccctgagactctcctgtgcagcctccggattccccttcagtagttattggatgacgttgggtccgccagacctccgaggggaaggggctggaggtgggtggccaacataaaagcaaagataggaactggccgtagttttacgnggactctgtggaagggtccgtttacaccatcctccagacacaaacgccaaagaattcactgtatctaacaactgaaacagcctagagagtcgacacgacaccggccgtagtattacgtgtgcgtaagagtaggtaaggaaaaagtagtaggtacttaggttagttttaaggtcgggggaccgaggggtacgtcccgtaggtcccaccggttccc

SEQ ID NO: 411525 - DNA, 562 bp, Homo sapiens
  misc_feature: GZ8MTXP02HNMFB.17.28.C06.1.454.CMB.2.raw
  modified_base (375)..(375): a, c, t, g, unknown or other
  modified_base (410)..(410): a, c, t, g, unknown or other
  modified_base (463)..(463): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggaggcctggtccagccgtgggggtccctgagactctcctgtgcagcctccggattcccctcagtagttattggatgacttgggtccgccagactccgagggaggggctggagtgggtggccaacataaagcaagatggaaactgccccgtagtttacgnggactctgtgagggtcctttcaccatcctccaganacaacgccaaagaatcactgtatctaacaactagaacagcctagagagtcganagaccacgggccgtagtattacgtgtgcgaagataggtacggaaaaagtataggctgttgttaagttggggacctaggggactcccgtaggtcctaccg

SEQ ID NO: 411526 - DNA, 555 bp, Homo sapiens
  misc_feature: GZ8MTXP02GSXEP.17.28.C06.1.454.CMB.2.raw
  modified_base (381)..(381): a, c, t, g, unknown or other
  modified_base (414)..(414): a, c, t, g, unknown or other
  modified_base (451)..(451): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccgagggaaggtgctggagtggggtggccaacataaagcaaagataggaactgaccgtagttttacgnggactctgtgaagggcctttcaccatctcaganacaacgccaagaattcactgtatctacaactgaaacngacctgagagtcgcagacacggcgtgtatactgtgcgagatagtaaggaaaaacgtatcggattggtaagtttacgttggggacaggggacgtcccgtggtccg

SEQ ID NO: 411527 - DNA, 603 bp, Homo sapiens
  misc_feature: GZ8MTXP02JFGTP.17.28.C06.1.454.CMB.2.raw
  modified_base (208)..(208): a, c, t, g, unknown or other
  modified_base (238)..(238): a, c, t, g, unknown or other
  modified_base (459)..(459): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcggggacccccgggnagagggtcaccatatcttgttctggaaacngctccggcatctacaactaaactatttttgctggtaccagcaattccccaggactccggccccccgactcctcatctatagaaatgatcagtccggcccctccggggtccctgaccgtacttcctcgtcggacctccattcgtcctggcctacctcacgtccctccctcgaccatcaggtcgggcctcccgggtccgaggactggaggctgtattattacngtgctacgggtggatcgactacgtcgtagtaagtcgggtccggtggttccggggacgggaacggggacccgagggtccgtacggacccgttaccgttaaaggcccgaacggaccccgaagggtccctccggtacccccgttcgg

SEQ ID NO: 411528 - DNA, 614 bp, Homo sapiens
  misc_feature: GZ8MTXP02GLXUR.17.28.C06.1.454.CMB.2.raw
  modified_base (377)..(377): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggaggcctggtccagccgtgggggtccctgagactctcctgtgcagccctccggacttccccttcagtagttatggatgacttgggtccgccagactccgagggaggggctggagtgggtggccaacataaagcaaagatggaactgcccgtagttttacgngtactctgtgaggggtccttcaccatcctcagagacaacgcaagaacttcactgtactactaacaaactgaaacagccctaggagacgtcgacgaagaccgaccgggtccgtagttacttacgtgttgacggtaagtagtagggtaaacgggaaaaaagttagtagggtactttgggttagtttaagggttcgggggaccgtagggggaccgtaccccggttgggtaccctacccgg

SEQ ID NO: 411529 - DNA, 615 bp, Homo sapiens
  misc_feature: GZ8MTXP02GHP07.17.28.C06.1.454.CMB.2.raw
  modified_base (216)..(216): a, c, t, g, unknown or other
  modified_base (269)..(269): a, c, t, g, unknown or other
  modified_base (293)..(293): a, c, t, g, unknown or other
  modified_base (369)..(369): a, c, t, g, unknown or other
  modified_base (507)..(507): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgttgctgtttagaagtgtcagtgtgaggtcagttggtgagtcggggagccnggtccagccgtgggggtccctgagactctcctgtgcagcctcggattcccctnagtattatggatgacttgggtccnccagactccgagggaaggggctggagtgggtggccaaacataaagcaaagatggaaactgacccgtagttttacgnggacttcgtgtgacggggtcctttcgacctatcctacagagacaacgaccaaagaacttcaacttgtacttacaacaaactacgaaacagacctggaacgtagtccgacaggaaccacgggaccgttgtaatttacgngttagcggaagtataggtaaggaaaaaacgttagtacgggtacgtaggtttagtttaagttacgggggtaccaaagggggtctaccccgtggggtttaccctacccgg

SEQ ID NO: 411530 - DNA, 560 bp, Homo sapiens
  misc_feature: GZ8MTXP02FQWCE.17.28.C06.1.454.CMB.2.raw
  modified_base (379)..(379): a, c, t, g, unknown or other
  modified_base (388)..(388): a, c, t, g, unknown or other
  modified_base (546)..(546): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtgggggtccctgagactctcctgtgcagcctccggattccccttcagtagttattggatgacttgggtccgccagactccgagggaaggggctggagtgggtggccaacataaagcaaagatggaactgcccgtagttttacgnggactctgngaggggcctttcaccatctccagagacaacgccaagaattcactgtatctaacaactagaacagcctagagagtcgacagaccacggccgtgtacttacgtgtgcgagatggtaaggaaaaagtatgggctggttgtttaagttggggaccaggggcnccgtggtctacccg

SEQ ID NO: 411531 - DNA, 610 bp, Homo sapiens
  misc_feature: GZ8MTXP02H1GV8.17.28.C06.1.454.CMB.2.raw
  modified_base (191)..(191): a, c, t, g, unknown or other
  modified_base (234)..(234): a, c, t, g, unknown or other
  modified_base (256)..(256): a, c, t, g, unknown or other
  modified_base (260)..(260): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtntctggacccccggcagagggtcaccatatcttgtctggaaacngctccgcatctacaactaactntttnctgaccagacaactccagactcccggcccccactcctcatactaataagaaatgatacacgtccggccccgtcccgggtccctcgaccccgtacttcctcgtcggtcctacctagtcgttcctcggaccctacctacaccgtccctccctaccaccactacgacggtcggtccgtcccggtccggacggtacgtacgacgacgtagtaattaacttacgttacgtcgtacgtacggtacggagtacgacgacgtacgtacgtacgtacggttcggtcggttcgggacggacgggacggacgcgtacgtaccgtaaccgtacgtacgacgaccgaccgaccgtccgtcccg

SEQ ID NO: 411532 - DNA, 553 bp, Homo sapiens
  misc_feature: GZ8MTXP02GOYW1.17.28.C06.1.454.CMB.2.raw
  modified_base (292)..(292): a, c, t, g, unknown or other
  modified_base (472)..(472): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattcccttccagtagttattgntgacttggtccgccagactccagggaggggcgtggaggtggtggcaacataaagacaagatggaactgcccgagtttacgtggactctgtgagggcgttcacatctcagagacaacgccaagaaattcactgtatctaacaatgaacagcctgagagtcgcagacacggcgtgtattacngtgcgagatgtaggaaaaagtatggctagttggtttaagttgggggacccgtaggggacgtccccgttgggtcctaacccg

SEQ ID NO: 411533 - DNA, 551 bp, Homo sapiens
  misc_feature: GZ8MTXP02JFP7X.17.28.C06.1.454.CMB.2.raw
  modified_base (378)..(378): a, c, t, g, unknown or other
  modified_base (536)..(536): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattccccttcagttagttattggatgacttgggtccgccagactccgagggaaggggctggagtgggtggccaacataaagcaaagatggaaactgccccgagttttacgnggactctgtgaggggtccgtttcacctatctccagagacaacgccaagaattcactgtatctacaactgaacagcctgagagtcgcagacacggcctagtatactgtgcgagatgtaaggaaaaagtatgactgtgtttaagtggggcctaaggggcncccgtaggtctaccg

SEQ ID NO: 411534 - DNA, 570 bp, Homo sapiens
  misc_feature: GZ8MTXP02F5AJX.17.28.C06.1.454.CMB.2.raw
  modified_base (273)..(273): a, c, t, g, unknown or other
  modified_base (298)..(298): a, c, t, g, unknown or other
  modified_base (371)..(371): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagctggtcagccgtgggggtcctgagactctcctgtgcagcctccggattccccttnagtagttatggatgacttgggtccncagactccgagggaggggctggagtgggtggccaacataaagcaaagatggaaactggcccgtagttttacgngactcgtgtgaggggtccttcacatctcagagacacgacaagaatcatgtatctaacaactagaacagccctagaggagtcgacagaccgacgggtccgtgttaacttacgtgtgcgagagtgtaaggtaaaaagtagtacggtactggttagtttaaggttcggggacgtacggggcgtacccgtcggtcctacccgg

SEQ ID NO: 411535 - DNA, 566 bp, Homo sapiens
  misc_feature: GZ8MTXP02FPM0U.17.28.C06.1.454.CMB.2.raw
  modified_base (207)..(207): a, c, t, g, unknown or other
  modified_base (244)..(244): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggnagaggtcaccatatcttgttctggaaacagctccggnatctacaaactaaactattttgctggtaccagcaattccccaggactccggccccccgactcctcatctataagaaatgatcagtccgcccgtccggggtccctgaccccgtattcctctgcctccatgtctggccacccgtcacgccctccctacgacctagtccaggtcgggccgttcccggccgaggactggacgtcgtagtattattactgtgaccgtacgtggatgacactcgtagagtcggtccggtggttcggcggacgggaccgcggcgtgacccgtaacgtaacggtcaccgccgtaaacgccgtcgcccccg

SEQ ID NO: 411536 - DNA, 590 bp, Homo sapiens
  misc_feature: GZ8MTXP02F3TR1.17.28.C06.1.454.CMB.2.raw
  modified_base (208)..(208): a, c, t, g, unknown or other
  modified_base (239)..(239): a, c, t, g, unknown or other
  modified_base (247)..(247): a, c, t, g, unknown or other
  modified_base (251)..(251): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtctcgggacccccggnagagggtcaccatatcttgttctaggaaacngctccggnatcncaactaactattttgctggtaccagcaacttcccgaggactcccggccccccgactcctcatctaatagaaatgatcacgtccggccccgtccggggtcccctgaccccgtattcctcgtcgctccattcgtctcggcctaccgtcacgtccctccctcgacctatcgtaggtcgggcctcccggtccgaggtacgtgagctagtattattacgtgtcgaccgaccggtggatacgactactcctagtacgtcggtccggttggttccgggacgggacggaccgacggcgtacgtacccgtaaccgtacgtacacggccgaacggtccgtcgtcccccg

SEQ ID NO: 411537 - DNA, 593 bp, Homo sapiens
  misc_feature: GZ8MTXP02GQ6G0.17.28.C06.1.454.CMB.2.raw
  modified_base (277)..(277): a, c, t, g, unknown or other
  modified_base (342)..(342): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattccccttnagtagttattggatgacttgggtccgccagacctccgaggggaaggggctggagtgggtgccaanataaagcaagatggaactgcccgtagtttactggactctgtgacggggtccgtttcacctatcctcagagacaacgaccaagaacttcactgtatctaacaactgaaacagcctagagagtcgacagaccgacggccgtgtaacttcgtgtgcgaagattaggtaaaggaaaaagtagtaggtcttaggtttaggtttaacggttcgggggaccgtagggggtaccgtcccggttacgggtacctacccgg

SEQ ID NO: 411538 - DNA, 615 bp, Homo sapiens
  misc_feature: GZ8MTXP02F4Y40.17.28.C06.1.454.CMB.2.raw
  modified_base (208)..(208): a, c, t, g, unknown or other
  modified_base (238)..(238): a, c, t, g, unknown or other
  modified_base (246)..(246): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggnagagggtcaccatatcttgttctggaaacngctccggnactctcaactaaactattttgctggtaccagcaattccccaggactcccggccccccgactcctcactctatagaaatgatcagtccggcccgtccggggtccctgaccccgtattcctcgtcggctccattcgtctcggcctacctcacgtccctccctgaccctatcgaggtcgggcctccggtccgaggtagtgaggtctaggtatttacgttacgtggtcgtaccgaaccggttgggattacgactatccgtagtaacggtcgggtccgggtggttcggggacggacggggacccgagggtccgtacggacccgttaaccgtaacggtacgaccggcccgaaacggtcccgtccggtccccccgg

SEQ ID NO: 411539 - DNA, 580 bp, Homo sapiens
  misc_feature: GZ8MTXP02GK1OG.17.28.C06.1.454.CMB.2.raw
  modified_base (373)..(373): a, c, t, g, unknown or other
  modified_base (432)..(432): a, c, t, g, unknown or other
  modified_base (447)..(447): a, c, t, g, unknown or other
  modified_base (483)..(483): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctggggggtccctgagactctcctgtgcagcctccggattccccttcagtagttattggatgacttgggtccgccagactccagggaaggggctggagtgggtggccaaacataaaagcaaagatggaactgccgagttttacgnggactctgtgaagggccgtttcaccatctccagagacaaacgccaaagaattcactganctaacaactgaaacngcctgagagtcgcagactacggccgtgtaattacgngtgcgagagtaggtaaaggaaaaagtagtggtacgttaggttagtttaacggtcgggggaccgaagggggtaccgtcccgtaggtaccgacccgttc

SEQ ID NO: 411540 - DNA, 568 bp, Homo sapiens
  misc_feature: GZ8MTXP02JC0CE.17.28.C06.1.454.CMB.2.raw
  modified_base (382)..(382): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagccctccggattcccccttcagtagttattggatgacttgggtcccgccagactccgaggggaaggggctggagtggggtggccaacataaagcaaagatggaaactgccccgtagttttcgnggactctgtgaggggtcctttcaccatctccagacgacaacgccaaagaattcactgtatctacaactgaacagccctagagagtcgcagacgacggcgtgtattacgtgtgcgagagttagtaggaaaaagttagtggacttgttagtttaagttggggaccgaggggactccgtggtcctaccg

SEQ ID NO: 411541 - DNA, 496 bp, Homo sapiens
  misc_feature: GZ8MTXP02FUMJ9.17.28.C06.1.454.CMB.2.raw
  modified_base (223)..(223): a, c, t, g, unknown or other
  modified_base (272)..(272): a, c, t, g, unknown or other
  modified_base (381)..(381): a, c, t, g, unknown or other
  modified_base (492)..(492): a, c, t, g, unknown or other
  modified_base (494)..(496): a, c, t, g, unknown or other
tcagcgtagactagcacgaccggtgctcgatttagagctcacgtattgggtttgggggtgtggtggtctccactcccgcccagtctgtgctgactcagccaccctcagtgtctgggacccccgggcagagggtcaccatatcttgttctggaaacagctccggcatctcaactaaacattttgctggtaccagcaattcccaggatcggccccccgactcctnatctatagaaatgatcatcggcccctccggggtcccctgacccgattcnctggctccatgctggcacctcagcctccctgacccatcagtggggctccggtccgaggatgaggctgatattactgtgcaccgtgggatgacatcctgaatggtccgtnttcggcggagggaccaggctgaccgtcctaaagtcagcccaaggctgccccctcggtcactctgttcccacccctctcctagtctacgctgagcgggctggcaaggcgcanannn

SEQ ID NO: 411542 - DNA, 540 bp, Homo sapiens
  misc_feature: GZ8MTXP02GIQGR.17.28.C06.1.454.CMB.2.raw
tcagcgtagactagcacgaccggtgctcgatttagagctcacgtattgggtttggggagcttcagctgtggtagagaagacaggattcaggacaatctccagcatggccggcttccctctcctcctaaccctcctcactcactgtgcagggtcctgggcccagtctgtgctgactcagccaccctcagtgtctgggacccccgggcagagggtcaccatatcttgttctggaaacagctccggcatctcaactaaacattttgctggtaccagcaattcccaggatccggccccccgactcctcatctatagaaatgatcatcggcccgtccgggtccctgaccgattcctctggctccatgtctggccacctcacgccctccctgacccatcaggtcggccgtccggtcccgaggactggaggctgattattactgtgcgaccggtgggatcgacatcctgaagtcgggtcggtggttcggcggagggaccgaggctcgaccgtctaagtcgacgcccgaggcctcgccccgtcggtcc

SEQ ID NO: 411543 - DNA, 610 bp, Homo sapiens
  misc_feature: GZ8MTXP02G4KQL.17.28.C06.1.454.CMB.2.raw
  modified_base (236)..(236): a, c, t, g, unknown or other
  modified_base (243)..(243): a, c, t, g, unknown or other
  modified_base (292)..(292): a, c, t, g, unknown or other
tcagcgtagactagcacgaccggtgctcgatttagagctcacgtattgggtttgggacagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggcagagggtcaccatatcttgtctggaaacngctccgnatctacaactaactatttgctgtacagcactccgagactcccggccccnctcctcatctataagaatgatcacgtccggccccgtccgggtccctcgaccccgtacttcctcgtcgctcctatcgtcgtcggaccacctccaccgtccctccctcgacctactcgacgggtcggtcccgtcccggtaccggaggtagtcggagtcgtagtactttacgttacgtgtcgacgtaccggtaggactacgactacgtacgtaggtacgttcgggttccgggtggtaccgggacggggacgggtaccgacggtccgtacggtacccgtaaccgtaacgtaccgaccgaccgaccggtccgtcccgtccccg

SEQ ID NO: 411544 - DNA, 577 bp, Homo sapiens
  misc_feature: GZ8MTXP02JIM5J.17.28.C06.1.454.CMB.2.raw
  modified_base (379)..(379): a, c, t, g, unknown or other
  modified_base (388)..(388): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccgagggaaggggctggagttggtggccaacataaagcaaagatggaactgccccgagttttacgnggactctgngacggggtccgtttcacctatcctaccagagacaacgacccaaagaattcaactgtatctaacaactgaacagcctgagagtccgcaagaccacggccgtagtattactcgtgcgagtagtagtaggaaaaagtaagtagactggttagtttaagttggggtacggacggagtcccgtggtcgtacccg

SEQ ID NO: 411545 - DNA, 559 bp, Homo sapiens
  misc_feature: GZ8MTXP02H6S4R.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagcctgggggtccctgagactctcctgtgcagcctccggattccccttcagtagttattggatgactgggtccgccagactccagggaaggggctggagtgggtggccaaacataaaagcaaagatggaaactgccccgagttttacgtggactctgtgaggggccgtttcaccatctcagagacaacgccaaagaattcaactgtatctacaaactgaaacagcctgagagtcgcagacaggcctgtaattactgtgcgagatagtaggaaaaaagtatagggcttagttgtttaagttggggaccaggggacgcccgtggctacccgg

SEQ ID NO: 411546 - DNA, 556 bp, Homo sapiens
  misc_feature: GZ8MTXP02F9HKD.17.28.C06.1.454.CMB.2.raw
  modified_base (376)..(376): a, c, t, g, unknown or other
  modified_base (476)..(476): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctgggggtccctgagactctcctgtgcagcctccggattccccttcagtagttattggatgacttgggtccgccagactccagggaaggggctggagtgggtggccaacataaagcaaagatggaactgccccgagtttacgnggactctgtgaggggcctttcaccatctcagagacaacgccaaagaatcactgatctacaactgaacagcctgagagtcgcagacacggcgtgtattacngtgcgagatggtaggaaaaagtaatggactggttagtttaagttgggggaccaagggggcgaccccgtggtactacccgg

SEQ ID NO: 411547 - DNA, 644 bp, Homo sapiens
  misc_feature: GZ8MTXP02JLYL2.17.28.C06.1.454.CMB.2.raw
  modified_base (276)..(276): a, c, t, g, unknown or other
  modified_base (302)..(302): a, c, t, g, unknown or other
  modified_base (373)..(373): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagcctggtccagcctgggggtccctgagactctcctgtgcagcctccggattccccttnagtagttattggatgacttgggtccnccagactccgagggaggggctggagtgggtggccaaacataaagcaagatggaactgcccgtagtttacgngactctgtagaggggtcctttcaccgtatctaccagacgaaccaacggacccaaagaacttcactagtatctaacaactacgaacacgtccgtaggacgtacgtacgacgaacggaccaccggggtacccgttaggttaacttaccggttggttaggacggtaacggtagttagggtaaagggtaaaaaagttaaacggtgggtaccgtttaggttaggtttaaggttcgggggaccgtagggggacgtccccgtagggttcctaacccgg

SEQ ID NO: 411548 - DNA, 567 bp, Homo sapiens
  misc_feature: GZ8MTXP02HD2RC.17.28.C06.1.454.CMB.2.raw
  modified_base (294)..(294): a, c, t, g, unknown or other
  modified_base (369)..(369): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtcagttggtgagtcggggagctggtccagcctgggggtccctgagactctcctgtgcagcctccggattccccttcagtagttatggatgacttgggtccnccagactccgaggggaaggggctgggagtgggtggccaacataaaagcaaagatggaactggccgtagtttacgnggactctgtgaagggccgtttcactatctccagagacaacgccaaagaattcactgtatctacaactgaacagcctagaagagtccgcagaccgacggccgtgtattactgtgcgagtagtaggtaggaaaaagtagtaggcgttaggttgtttaaggtcggggccagggggtacgcccgttacggtccaccggttcc

SEQ ID NO: 411549 - DNA, 639 bp, Homo sapiens
  misc_feature: GZ8MTXP02IZX7Z.17.28.C06.1.454.CMB.2.raw
  modified_base (239)..(239): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtctcgggacccccggcaggagggtcaccatatcttgttctggaaacngctccggcatctacaactaaactattttgctggtaccagctaacttcccgaggactcccggcccccactcctcatctatagaaatgatcacgtccggcccgtccggggtccctcgaccccgtacttcctctcggtcctcccgattcgtccttcggccctaccctccgacgtcccctcccgtacgtaccctacgtccgtaagggtcggggtcccgttcccggggttcccggaagggtacgttagggacggtcttaggtaactttacttaacgttgttacgcgtaccggtagggacttcgactacgtccgtaggtacgttcggggttccggttggttcggggcgggacggacgtcggccgtcgaccgtcgtaacgcaccggccgacggccgtcccgtccccg

SEQ ID NO: 411550 - DNA, 600 bp, Homo sapiens
  misc_feature: GZ8MTXP02I3LAL.17.28.C06.1.454.CMB.2.raw
  modified_base (274)..(274): a, c, t, g, unknown or other
  modified_base (375)..(375): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagcctggtccagcctgggggtcctgagactctcctgtgcagcctccggattcccctnagtagttattggatgacttgggtccgccagactccgagggaaggggctggagtgggtggccaaacataaagcaaagatggaaactgccccgtagtttacgnggactctgtgagggcctttcacctatctaccagacacaacgccaaagaacttcaactgtactctaacaactacgaaacagacctgagagtcgacaacgacacgggtccgtgttaacttactggtacgcggtaagtagtaggtaaacgggtaaaaaagtagttaggggtacttggttagtttaagttgggggaccctagggggacgtcccgtgggtacctacccgg

SEQ ID NO: 411551 - DNA, 570 bp, Homo sapiens
  misc_feature: GZ8MTXP02GKQE7.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagccctccggattcccccttcagtagttattggatgacttgggtccgccagactccgagggaaggggctggagtgggtggccaacataaagcaaagatggaaactgccccgtagtttacgtggactctgtgagggtccgtttcaccatctcagagacacgccaagaattcactgtatctaacaactgaacagcctgagagtcgacagaccacggccgtgtacttactgtgcgagatggtaaggaaaaagtagtcggacttgttagtttaagtgggggaccagggggacgccccgttgggtacctacccg

SEQ ID NO: 411552 - DNA, 569 bp, Homo sapiens
  misc_feature: GZ8MTXP02H7COU.17.28.C06.1.454.CMB.2.raw
  modified_base (368)..(368): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtcagttggttgagtcggggagcctggtccagcctgggggtcctgagactctcctgtgcagcctccggattcccctcagtagtatggatgactggtccgccagactcgagggaaggggctggagtgggtggccaaacataaaagcaaagataggaactgcccgagttttacgnggactctggtgagggtcctttcaccatctccagacgacaacgccaaagaattcactgtatctaacaactgaacagcctagagagtacgcaagacgacggtccgtagtacttacgtgtgacgagagtgaaggtaaaaagtactggacttgttaggtttaagttcgggggacctagggggacgtcccgtgggttaccacccgg

SEQ ID NO: 411553 - DNA, 535 bp, Homo sapiens
  misc_feature: GZ8MTXP02F7YZF.17.28.C06.1.454.CMB.2.raw
  modified_base (484)..(484): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggcagagggtcaccatatcttgttctggaaacagctccggcatctcaactaaacattttgctggtaccagcaattcccaggactccggccccccgactcctcatctatagaatgatcatcggccctccggggtccctgaccccgtattcctctgctccatgtctgcacctcacgcctccctgaccatcagtcggcctccggcgaggactgagctagtattattactgtgcacggtggatgacatccagaagtcggtccggtgttcgggcggacgggaccnggactcgaaccgtccgttaaagccgaacgcccgaaggtcctcgtccccccg

SEQ ID NO: 411554 - DNA, 615 bp, Homo sapiens
  misc_feature: GZ8MTXP02FZXY4.17.28.C06.1.454.CMB.2.raw
  modified_base (380)..(380): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagcctggtccagccgtgggggtccctgagactctcctgtgcagcctccggattccccttcagtagttattggatgacttgggtccgccagactccgagggaaggggctggagtgggtggccaacataaagcaaagataggaaactggaccccgtagttttacgnggtactcgtggtagaggggtcccgtttcaccgtatcctaccagagaacaacgacccaaagtaacttcactgtatctaacaactagaacagcctaggaagtagtccgacagaccgacgggtccgtagtattacgtgtcgtcgaagagttaggaaaggtaaaaaagttagttgggtacgttggtttaggtttaaggttcgggggacctagggggactcccggtagggtcctacccgg

SEQ ID NO: 411555 - DNA, 555 bp, Homo sapiens
  misc_feature: GZ8MTXP02IEL7I.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaaactgccccgagttttacgtggactctgtgaggggcctttcaccatcctcagagacaacgccaaagaattcactgtatctacaactgaacagcctagagagtcgcagacacggccgtgtattactgtgcgagatgtaggaaaaagtatggacttgtgtttaagttgggggacctaggggagtccgtggtactacccg

SEQ ID NO: 411556 - DNA, 552 bp, Homo sapiens
  misc_feature: GZ8MTXP02HVP6X.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtcagcctgggggtccctgagactctcctgtgcagccctccggattccccttcagtagttattggatgacttgggtccgccagactccgaggggaaggggctggagtgggtggccaacataaagcaaagatggaactgcccgagttttacgtgactctgtgagggtcgtttcaccatctccagagacaacgccaaagaattcactgtatctacaactgaacagcctgagagtcgacagacacggcgtgtattactgtgcgagagtagtaggaaaaagtatcggctagtgtttaagttggggcctaggggacgtcccgtggtccaccg

SEQ ID NO: 411557 - DNA, 633 bp, Homo sapiens
  misc_feature: GZ8MTXP02HB3A8.17.28.C06.1.454.CMB.2.raw
  modified_base (264)..(264): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccggcagagggtcaccatatcttgttctaggaaacagctccggcatctacaaactaaactnttttgctggtaccagcaacttcccaggactcccggccccccgactcctcatctaataagaaatgatcagtccggccccgtccggggtccctgaccccgtattcctcgtggctccatcgtctgccacctcacgccctccctgaccatcgaggtcggccgtccggtccgaggatgaggctagtattattactgtcgcgtaccggtgggtatcgaactacgtcccgtaggtaacgttcggggtcccgggttcgggttaccggggacggggtaccggggtaacccgtacgggaccgtttcggaaccccgttaaccgttaaacggtacccgaaccggaccccgaaacggggtcccttacccggtccccccccgg

SEQ ID NO: 411558 - DNA, 548 bp, Homo sapiens
  misc_feature: GZ8MTXP02FRAIJ.17.28.C06.1.454.CMB.2.raw
  modified_base (207)..(207): a, c, t, g, unknown or other
  modified_base (237)..(237): a, c, t, g, unknown or other
  modified_base (357)..(357): a, c, t, g, unknown or other
  modified_base (438)..(438): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggnagagggtcaccatatcttgttctggaaacngctccggcatctcaaactaaactatttttgctggtaccagcaattcccaggatccggccccccgactcctcatctatagaaatgatcatcggccctccggggtccctgaccccgattccntcggctccatgtctggcacctcagccctcctgaccatccgagtcggcttcccggccgaggactgaggctagattattatgngtcacgtggatgactatctagtaactgggtccggtgtttcgggacggacgggaccgacggtccgtacgaccgtaacgtaacgtcacggcccgaaggccctcgtccccccg

SEQ ID NO: 411559 - DNA, 554 bp, Homo sapiens
  misc_feature: GZ8MTXP02F65DS.17.28.C06.1.454.CMB.2.raw
  modified_base (372)..(372): a, c, t, g, unknown or other
  modified_base (447)..(447): a, c, t, g, unknown or other
  modified_base (482)..(482): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctggggggtccctgagactctcctgtgcagcctccggattccccttcagtagttattggatgacttgggtccgccagactccgagggaaggggctggagtgggtggccaacataaagcaagatggaactgccgtagttttacgnggactctgtgaagggtccgtttcaccatctccagagacaacgccaaagattcacttgtatctaacaactgaaacngcctagagagtcgacagacacggcgtcgtattacngtgcgagatagtaggaaaagtagtggcttggtgtttagtggggaccgagggacgtccgtggtaccaccgtcc

SEQ ID NO: 411560 - DNA, 614 bp, Homo sapiens
  misc_feature: GZ8MTXP02IYGTW.17.28.C06.1.454.CMB.2.raw
  modified_base (235)..(235): a, c, t, g, unknown or other
  modified_base (400)..(400): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggaccccgggcagagggtcaccatatcttgttctggaaacngctccggcatctcaaactaaactattttgctggtaccagcaatcccaggactccggccccccgatcctcatctatagaaatgatcactcggccccgtccggggtccctgaccgacttcctcgtcggctccatcgtctcggcaccctcacgccctccctgaacccntcgacggtcgggccttcccgggtcgaggtactggacgggcttaggtaatttacgttacgtcggtcgaccgtaccgggtaggggacttgaacctacgtcccgtaggtaacgtttcgggtaccgggttcgggttacggggaccggggtacgggacccgacgggtcgtacggacccgtacgtaacgcgacgcccgaacggccgtcgcccccgttcgg

SEQ ID NO: 411561 - DNA, 621 bp, Homo sapiens
  misc_feature: GZ8MTXP02JRZ4S.17.28.C06.1.454.CMB.2.raw
  modified_base (377)..(377): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtgggggtccctgagactctcctgtgcagcctccggattccccttcagtagttattggatgacttggtccgcagacctcgagggaggggctggagtgggtggaccaacataaagcaagatggaactgaccccgtagtttacgngactcgtgtgacgggtccgtttacaccgtatcctccgagacgaacaaccgaccaaagaaacttcaacgtgtatctaacaactagaacagcctagagagtcgcagacgacggcgtagtattacgtgtcgacggtagagttagggtaagggaaaaaagttacgtacgggtacttagggtttaggtttaaggggttcgggggaccggtaacgggggtaccgtccccggttcggggtaccttccccgg

SEQ ID NO: 411562 - DNA, 646 bp, Homo sapiens
  misc_feature: GZ8MTXP02G5U2T.17.28.C06.1.454.CMB.2.raw
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggcaggagggtcaccatatcttgtctggaaacagctccggcatctacaactaaactattttgctggtaccagcaattcccaggactccggccccccgactcctcatcctaatagaaatgatcactccggcccctccggggtccctgaccccgtattcctcgtcggctccattcgtcctggccaccgtcacgccctccctcgaccatcgaggtcggcctccggtaccgaggactgacggctgtattattactggtacgcgtaccggtaggagtcgaactacgtcccgttaggaaacgttcggggttcccgggttgggtttccggggaccgggaacggggaaccccggaaggtacccgttccgggtaaccccgttaaccgtaaacggttacccgaaccggacccccgtaaacgggaccccgtttacccccgtacccccccggg

SEQ ID NO: 411563 - DNA, 504 bp, Homo sapiens
  misc_feature: GZ8MTXP02JGG2T.17.28.C06.1.454.CMB.2.raw
  modified_base (346)..(346): a, c, t, g, unknown or other
  modified_base (363)..(363): a, c, t, g, unknown or other
  modified_base (470)..(470): a, c, t, g, unknown or other
  modified_base (490)..(490): a, c, t, g, unknown or other
  modified_base (494)..(504): a, c, t, g, unknown or other
tcagcgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaaactaaacatttttgctggtaccagcaattcccaggatcggccccccgatcctcatctatagaaatgatcatcggccctccggggtccctgaccgattctctggctccatgtctggcacctcagcctccctgaccatccagtggctccggtccgaggatgaggctgattattacngtgcacgtgggatgacntcctgaatggtcggtgttcgggcggagggaccaggctgaccgtctaagtcacgcccgaaggctcgcccccgtcggtcactctcgtcccacctctccatcacgctagngcggctggcaacggcgctanacgnnnnnnnnnnn

SEQ ID NO: 411564 - DNA, 591 bp, Homo sapiens
  misc_feature: GZ8MTXP02FYU18.17.28.C06.1.454.CMB.2.raw
  modified_base (383)..(383): a, c, t, g, unknown or other
tcagcgtagactagcacgaccggtgctcgatttagagctcacgtattgggtttggggaggtctcagagaggaggcttagacctggactccaaggcctttccacttggtgatcagcactgagcacagaggactcaccatggagttggggctgaactgggttttccttgttgctgtttagaaggtgtccagtgtgaggtcagttggtgagtcggggagctggtccagccgtgggggtccctgagactctcctgtgcagcctccggattccccttcagtagttattggatgacttgggtccgccagactccgaggggaaggggctggaggtggggtggccaaacataaagcaaagatggaactgaccccgtagttttactggactntgtgacgggtccttcactatctacagacgacaacgaccaaagaacttcattgtatactaacaactagaacagcctagagagtcgacagaccgacggccgtgttaacttacgtgtcgacgaagtagttaggtaaggaaaaagttagtcggtacttggtttagtttaaggttcggggaccgaggggacgtcccgtcgggtacctacccgg

SEQ ID NO: 411565 - DNA, 631 bp, Homo sapiens
  misc_feature: GZ8MTXP02G8B7I.17.28.C06.1.454.CMB.2.raw
  modified_base (297)..(297): a, c, t, g, unknown or other
  modified_base (374)..(374): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaggtgtccagtgtgaggtcagttgtgagtcggggagcctggtccagccgtgggggtccctgagactctcctgtgcagcctccggacttccccttcagttagttattggatgacttgggtccnccagactccgaggggaaggggctgggaggtgggtggccaaacataaaagcaagataggaactgccgtagttttacgnggactcgtggtagaacgggtccgtttcacctatcctaccagacgacaacgccaaagattcactgtactctaacaactcgaaacacgacctaggaagacggtccgacaacggaccgaccgggtcccgttaggttaactttaacgtggttacgacggtaagtagtaggtaaaggtaaaaaacgttagtgggtacttaggtttagtttaaggtcgggggaccgtaggggaccgtcccgtacggtacccgtaccgttcccg

SEQ ID NO: 411566 - DNA, 552 bp, Homo sapiens
  misc_feature: GZ8MTXP02FNW6Q.17.28.C06.1.454.CMB.2.raw
  modified_base (450)..(450): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacattttgctggtaccagcaattcccaggatccggccccccgactcctcatctatagaaatgatcatcggccctccggggtccctgaccccgattctctgctccatcgtctggcacctcacgcctccctgaccatcagtgggcctccggtccgaggacgtgagctgtattattactgtgcaccgtggatcgacntcctgagtcgggtccggtggttcgggcgggacgggaccgacggtcgtcggtacccgtaaccgtaaacgtccgaacgccccgaacggtcctccggtccccccg

SEQ ID NO: 411567 - DNA, 607 bp, Homo sapiens
  misc_feature: GZ8MTXP02IF0F0.17.28.C06.1.454.CMB.2.raw
  modified_base (238)..(238): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggcagagggtcaccatatcttgttctaggaaacngctccggcatctacaactaaactatttttgctggtaccagcaacttcccaggactcccggccccccgatcctcatctatagaaatgatcatccggccccgtccggggtccctgaccccgtattcctctggctccattcgtctgccacctcacgcctccctgaccatcgaggtcggcgtcccggtcgaagctggagctagtatttaagttcgttgtcgaccgtaccggttggggattggactacgttccgtaggtaaacgttcggggttccggttggttccgggggacggaacggggaccgacgggtccgtacggtacccgtaacgttaaacggcaccggacccgaacgggtcctacccggtccccccgg

SEQ ID NO: 411568 - DNA, 574 bp, Homo sapiens
  misc_feature: GZ8MTXP02G2CM0.17.28.C06.1.454.CMB.2.raw
  modified_base (375)..(375): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattccccttcagtagttattggatgacttggtccgccagactccgagggaaggggctggagtgggtggccaacataaagcaaagatggaactgccccgtagtttacgnggactctgtgagggccgtttcaccatctcagacgacaacgccaaagaattcactgtatctaacaactagaaacagcctagagtagtcgacaagaccacgggccgtgtaacttacgtgtgcgagataggtaaggaaaaagtagtggactggttgtttaagttgggggaccgtaggggacgcccgtcgggtacctacccgg

SEQ ID NO: 411569 - DNA, 608 bp, Homo sapiens
  misc_feature: GZ8MTXP02F5NJ2.17.28.C06.1.454.CMB.2.raw
  modified_base (381)..(381): a, c, t, g, unknown or other
  modified_base (487)..(487): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggaggcctggtccagccgtgggggtccctgagactctcctgtgcagcctccggacttccccttcagttagttatggatgacgttgggtccgccagacctccgaggggaaggggcgtgggaggtggggtgccaaacataaagcaaggataggactgccgtagtttacgnggactcgtgtgagggtccgttcactatctcagagacaacgcaagatcactgtactctacaactgaacagcctagagacgtcgcagacgacgccgtagtacttacgngtagacgagtagtaggaaaggtaaaaagtagtacggtacgttaggtttaggttttaacgggtcgggggtaccggtaacgggggtaccgtccccggttacgggtccctaacccggtttcccg

SEQ ID NO: 411570 - DNA, 640 bp, Homo sapiens
  misc_feature: GZ8MTXP02G9FJY.17.28.C06.1.454.CMB.2.raw
  modified_base (375)..(375): a, c, t, g, unknown or other
  modified_base (383)..(383): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagccctccggattccccttcagtagttattggatgacttgggtccgccagactccgagggaaggggctggagtgggtggccaacataaagcaagatggaactgcccgtagtttacgngactctgngagggcctttcaccatctcagacgacaacgccaaagaattcactagtatctaacaactagaacagcctagagtacgtcgacgaacgaccaaccggggtcccgttaggtaactttaccgtagggttacggaccggtaaggtaagtttaggtaaaggggtaaaaaaacgttaacggttaggggtacttaggtttaggttttaaggtttcgggggacccgtagggggtaccggtccccgttcgggtacccgtaaccccgg

SEQ ID NO: 411571 - DNA, 560 bp, Homo sapiens
  misc_feature: GZ8MTXP02HF6KH.17.28.C06.1.454.CMB.2.raw
  modified_base (342)..(342): a, c, t, g, unknown or other
  modified_base (376)..(376): a, c, t, g, unknown or other
  modified_base (433)..(433): a, c, t, g, unknown or other
  modified_base (437)..(437): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagcctgggggtccctgagactctcctgtgcagcctccggattccccttcagtagttattggatgacttgggtccgccagactccgagggaaggggctggaggtgggtgccaanataaagcaagatggaactgcccgtagttttacgnggtactctgtgagggtccgtttcaccatcctcagacacacgccaagattcactgtanctanaactagaacaccctgagagtcgacagaccacggccgtgtatactgtgcgagatggtaggaaaagtagtaggcttagttgtttaggttggggccgaaggggtcgaccgtcggtcctaccggtcc

SEQ ID NO: 411572 - DNA, 668 bp, Homo sapiens
  misc_feature: GZ8MTXP02HF1QO.17.28.C06.1.454.CMB.2.raw
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggcagagggtcaccatatcttgttctggaaacagctccggcatcctcaactaaactattttgctaggtaccagacaattcccaggactcccggccccccgactcctcatctatagaaatgatcatccggccctccggggtccctgaccccgtattcctctggctcattcgtcgtcgccaccctcacgtccctccctgaccctatcgacgggtcgggcccgttcccgggtacccggaagggacgtacggacgggtacctaggttaaatttacgtttaacgttgtacggtacccgaaccgggttggggaattcggaaacctacgttacccgtaggtaaacggtttcggggtcccgggttacggggtttcggggacggggaaacggggacccgtacgggtccgtacggtaacccgttaaccgtaaacgtaccgacggaacccgaacggcccgttccggtccccccg

SEQ ID NO: 411573 - DNA, 603 bp, Homo sapiens
  misc_feature: GZ8MTXP02GQAQC.17.28.C06.1.454.CMB.2.raw
  modified_base (280)..(280): a, c, t, g, unknown or other
  modified_base (381)..(381): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtgggggtccctgagactctcctgtgcagcctccggattcccctnagtagttattggatgacttgggtccgcagactccgaggggaaggggctggaggtggggtggccaacataaagcaaagatggaactgccccgtagtttacgnggactctgtggagggtccgtttcaccatctccagacgacaacgccaagaattcactgtactctacaactgaacagcctagagagtcgacagaccgacgggtccgtgtacgttacctggtcgacgagtagttaggtaaagggtaaaaagtagtagggtacttggtttagtttaaggttcgggggaccctagggggtaccgtcccggtcggggtacctacccgg

SEQ ID NO: 411574 - DNA, 609 bp, Homo sapiens
  misc_feature: GZ8MTXP02FYPGN.17.28.C06.1.454.CMB.2.raw
  modified_base (391)..(391): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtgggggtccctgagactctcctgtgcagccctccggattccccttcagtagttattggatgtacttgggtccgccagacctccgaggggaaggggctggaggtggggtggccaaacgataaaagcaaagataggaactggccccgtagtttacgnggtactcgtgtgagggtccttcaccatcctcagagacaacgaccaagaacttcactgtatactacaactagaaacagcctagagagtacgacagaaccgacgggaccgtagttaacttacgtggtagcgagtagttaggtaaggaaaaaagtagtacggtacttaggttagtttaaggtgggggtaccgagggggactcccggttcggtcctacccgg

SEQ ID NO: 411575 - DNA, 555 bp, Homo sapiens
  misc_feature: GZ8MTXP02JZ5IH.17.28.C06.1.454.CMB.2.raw
  modified_base (377)..(377): a, c, t, g, unknown or other
  modified_base (500)..(500): a, c, t, g, unknown or other
  modified_base (541)..(541): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagcctggtccagcctgggggtccctgagactctcctgtgcagcctccggattccccttcagtagttattggatgacttgggtccgccagactccgaggggaaggggctggagtgggtggccaacataaagcaaagatggaactgccccgtagttttacgnggactctggtgaggggtccgtttacaccatctccagacgacaacgccaagtaattcactgtatctacaactgaaaccaccctagagagtcgacagaccacggccgtagtattactgtgcgagntagtaggaaaagtatggctgttgttagtggggcaggggacncccgtgcaccgtcg

SEQ ID NO: 411576 - DNA, 626 bp, Homo sapiens
  misc_feature: GZ8MTXP02FI78S.17.28.C06.1.454.CMB.2.raw
  modified_base (207)..(207): a, c, t, g, unknown or other
  modified_base (237)..(237): a, c, t, g, unknown or other
  modified_base (245)..(245): a, c, t, g, unknown or other
  modified_base (262)..(262): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctggggacccccgggnagagggtcaccatatcttgttctggaaacngctccggnatctacaaactaaactnttttgctggtaccagcaattcccaggactccggccccccgactccctcatactaataagaaaatgatcagtccggcccctccggggtcctcggaccgactttctcgtcggcctcattcgtcgtcgccaccgtcacgccctccctagacccatccgagtcgggcctcccgggtcgaggatggaggtctagtatttattacgtggtcgcgtaccgggtgggacttggactacgttccgagtaacgttcggggttcccggttagggttccggggacggggacgggacccgaggggtccctacggtacccgttaccgtaacggtccgaacggaccccgtaacgggtcctacccggtacccccgttcgg

SEQ ID NO: 411577 - DNA, 541 bp, Homo sapiens
  misc_feature: GZ8MTXP02G6QGB.17.28.C06.1.454.CMB.2.raw
  modified_base (236)..(236): a, c, t, g, unknown or other
  modified_base (461)..(461): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacngctccggcatctcaaactaaactatttttgctggtaccagcaaattcccaggactccggcccccccgatccctcatctatagaaatgatcatcggcccctccggggtcctgaccgattcctctggccttccattcgtctggccacctcagccctccctgacccatcagtgggcctccggtccgaggatggaggctgattattactgtgcacgtggatgacattcngaatggtccggtgttcgggcggagggaccagggtctcggaccggttactaaagccagccccaaggctccgccccctacgg

SEQ ID NO: 411578 - DNA, 590 bp, Homo sapiens
  misc_feature: GZ8MTXP02FVQQG.17.28.C06.1.454.CMB.2.raw
  modified_base (367)..(367): a, c, t, g, unknown or other
  modified_base (400)..(400): a, c, t, g, unknown or other
  modified_base (443)..(443): a, c, t, g, unknown or other
tcagcgtagactagcacgaccggtgctcgatttagagctcacgtattggggtttggggctcagagaggaggcttagccctggactccaaggcctttccacttggtgatcagcactgagcacagaggactcaccatggagttggggctgaactgggttttcctgttgctgttttagaaggtgtccagtgtgaggtccagttggttgagtcggggagcctggtccagcctgggggtcctgagactctcctgtgcagcctccggattccccttcagtagttatggatgacttgggtccgccagactccgaggggaaggggctggagtgggtggccaacataaagcaagatggaactggccgagtttacgngactctgtgaagggtccttcacatcctccaganacaacgaccaaagaattcactgtatctaacaaacttgaaaacngacctagagagcgacaacgacgaccggcgtagtacttacgtgtagcgtaagtaagtaggtaaaggtaaaaacgtaagtcggtacttaggttaggtttaaggtcgggggaccgtaggggtacgtcccggtacggtccgacccgttccg

SEQ ID NO: 411579 - DNA, 630 bp, Homo sapiens
  misc_feature: GZ8MTXP02G1G4U.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggttgagtcggggagcctggtccagcctgggggtccctgagactctcctgtgcagcctccggacttccccttcagtagttattggatgacttggtccgccagactccgaggggaaggggctggagtgggtggaccaaacataaagcaaagatggaaactgaccccgtagttttacgtggactcgtggtagacggggtcctttcgacctatcctacagagaacaacgaccaaagaatcgactagtactactaacaactagaaacacgacctagaagtagtcgacgaacgaaccgacgggacccgttaggttaactttacgtggttacgcggtaaggattagggtaaaggtaaaaaagttaagtggtacgttaggtttagtttaagggttcgggaccgtacggggacgtacccgtcggtacctacccgg

SEQ ID NO: 411580 - DNA, 637 bp, Homo sapiens
  misc_feature: GZ8MTXP02FN5BI.17.28.C06.1.454.CMB.2.raw
  modified_base (209)..(209): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtctcgggacccccgggnagagggtcaccatatcttgttctggaaacagctccggcatctacaaactaactattttgctggtaccagcaacttcccaggactccggccccccgatcctcatctatagaaatgatcacgtccggccccgtccggggtcccctgaccccgtattcctctcggtcctccatcgtcgtggaccacctcacgccctccctagaccatcgacggtcgggcccgtacccggtccgaaggtacgtcggaggtcttaggtatttaacgttaccgtgttacgaccggtaccggtggggtactcgtaacgtaacttcccgtaagtaacggtcgggttccgggttaggttccggggacggtaacgggaccgacggtcgtacggaacccggtaacttaaacggccaaccggacccgaacggtccgtacccgtcccccgg

SEQ ID NO: 411581 - DNA, 560 bp, Homo sapiens
  misc_feature: GZ8MTXP02FSZ31.17.28.C06.1.454.CMB.2.raw
  modified_base (302)..(302): a, c, t, g, unknown or other
  modified_base (337)..(337): a, c, t, g, unknown or other
  modified_base (373)..(373): a, c, t, g, unknown or other
  modified_base (543)..(543): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggaggcctggtccagcctgggggtccctgagactctcctgtgcagcctccggattccccttcagtagttatggatgacttgggtccnccagactccgagggaggggctggagtggtgccaanataaagcaagatggaaactgccccgtagttttacgnggacttctggtgaggggccgtttcaccatctaccagagacaacggaccaaagaattcactgtactctaacaactagaacagcctagagatcgacagacacggccgtgttatactgtgcgagatgtaaggaaaaagtagtggactggttgttaagtggggaccaggggacncccgtaggtcctaccgg

SEQ ID NO: 411582 - DNA, 582 bp, Homo sapiens
  misc_feature: GZ8MTXP02JMRFL.17.28.C06.1.454.CMB.2.raw
  modified_base (207)..(207): a, c, t, g, unknown or other
  modified_base (237)..(237): a, c, t, g, unknown or other
  modified_base (261)..(261): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggnagagggtcaccatatcttgttctggaaacngctccggcatctacaactaaactnttttgctggtaccagcaattcccaggactccggccccccgatcctcatctatagaaatgatcatccggcccctccggggtcctgaccgacttctctggctccattcgtctcggccacctcacgccctccctgaccatcgacgtcggcctccggtccgaggatggagctagtattacttactgtgcgaccggtgggactgactatccgtagtaacgttcgggtccggttcgggttcggggacggggaacggggaccgacgggtccgtacggacccgttacgtaaacgtccgaacggcccgaaggcctccggcccccgttcgg

SEQ ID NO: 411583 - DNA, 572 bp, Homo sapiens
  misc_feature: GZ8MTXP02J3F0F.17.28.C06.1.454.CMB.2.raw
  modified_base (302)..(302): a, c, t, g, unknown or other
  modified_base (376)..(376): a, c, t, g, unknown or other
  modified_base (408)..(408): a, c, t, g, unknown or other
  modified_base (433)..(433): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttgtgagtccggggagcctggtccagccgtgggggtccctgagactctcctgtgcagcctccggattcccccttcagtagttattggatgacttgggtccnccagactccgagggaaggggctggagtgggtggccaacataaagcaaagatggaactgccccgagtttttacgnggactctgtgagggccgtttcacatctcaganacaaacgccaagaattcactgtacnctacaactgaaacagcctagagagtcgacagaccacggcccgtgtacttacgtgtcgacgagataggtaaggaaaaaagttagtggacttggttaggtttaagttgggggcccaggggacgcccgtggtactaccccgg

SEQ ID NO: 411584 - DNA, 726 bp, Homo sapiens
  misc_feature: GZ8MTXP02GQ31M.17.28.C06.1.454.CMB.2.raw
  modified_base (336)..(336): a, c, t, g, unknown or other
  modified_base (378)..(378): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagctggtccagccgtgggggtccctgagactctcctgtgcagcctccggattcccctcagtagttatggatgacttggtccgccagactccgaagggagggctggagtgggtcgaccaanaagtaaagcgaaagagtaggaaactgacccgtagttttacgnggtacttcgtaggtaggtacgggggtcccgtttacaacccgttactccgtaaccgaagaacgaaaccgaacccgaaacgtaaaagtacttacacgttataccttaaccaaaacgttacgaaacgaaacgtaccgtaccgaggaacggttacgccgaacggaacggaacccgtaccggggtccgttaagtttacttaccgttgggtcgaacggtaagtaacgggttagggtaaaaaacgggtaaaaaggtttcggtcggttaacgtttgggttttaaaggttaacgggggttacgggggaccggtaaacggggtcccggtaccggttccgggtaccggtttaacccccg

SEQ ID NO: 411585 - DNA, 624 bp, Homo sapiens
  misc_feature: GZ8MTXP02IACBD.17.28.C06.1.454.CMB.2.raw
  modified_base (359)..(359): a, c, t, g, unknown or other
  modified_base (365)..(365): a, c, t, g, unknown or other
  modified_base (389)..(389): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggcagacggtcaccatatcttgttctggaaacagctcggcatctacaaactaaactatttttgctggtaccagcaaatcccagactcggcccccgatcctcatctataagaaatgatcatcggccctccggggtcctgaccgattctctgctcatntctgcncctcacgtccctcctcgaccctanacgacggtcggtccgtccgtacggaggacgtagacgtctagtatttattacgtggttcgaccgtaccgggtaggtactacgaactacgttcgtaacggtaacgttcggggttccgggttcgggttacggggacggggaaacgggtacccggtacggtaccgttaccggtaacccgtaccgtaaacgtaccgaaccggtacccggaacggtcccgtacccggttacccccgtccgg

SEQ ID NO: 411586 - DNA, 614 bp, Homo sapiens
  misc_feature: GZ8MTXP02FY5LA.17.28.C06.1.454.CMB.2.raw
  modified_base (375)..(375): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggtgagtccggggaggcctggtccagcctgggggtccctgagactctcctgtgcagcctccggattccccttcagtagttatggatgacttgggtccgccagactccgagggaaggggctggagtgggtggccaacataaagcaagataggaactgaccccgtagtttacgnggactctgtggagggtcctttcacctatctaccgagacgacaaacgcccaaagaacttcaacttagtacttactaacaactagaacagacctgaacgagtcgacgagaccacgggccgttagttaacttactggtgacggaagtagttaggtaaagggtaaaaagttagtgggtacttggtttaggtttaaggttcgggggaccgtagggggtaccgtcccgttgggtaccctacccgg

SEQ ID NO: 411587 - DNA, 567 bp, Homo sapiens
  misc_feature: GZ8MTXP02FIAAU.17.28.C06.1.454.CMB.2.raw
  modified_base (370)..(370): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgtgctgttttagaaggtgtcagtgtgaggtcagttggttgagtccggggaggctggtccagcctgggggtccctgagactctcctgtgcagcctccggattccccttcagtagttattggatgacttgggtccgccagactccgagggaaggggctggagtgggtggccaacataaagcaagatggaactgcccgtagtttacgnggactctgtgagggccgtttcaccatctccagagacaacgccaaagaattcaactgatctaacaactagaacagcctgagagtcgcagacacggccgtgtatactgtgcgagagtaggtaaggaaaaagtagtacggtcgtggtttaggtttaaggttcgggggaccgaagggggtacgcccgtgggtcctacccgg

SEQ ID NO: 411588 - DNA, 520 bp, Homo sapiens
  misc_feature: GZ8MTXP02JZD7P.17.28.C06.1.454.CMB.2.raw
  modified_base (363)..(363): a, c, t, g, unknown or other
  modified_base (509)..(520): a, c, t, g, unknown or other
tcagcgtagactagcacgaccggtgctcgatttagagctcacgtattgggtttgggggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctcggggtccctgaccgattctctggctccatgtctggcacctcagccctccctgacccatcagtggctccggtccgaggatgaggctgtattatactgtcgcacgtgggatgacntcctgaatggtccggtgttcgggcggagggaccaggctcggaccgtcctaagtcacgcccgaaggcctcgcccccgtcggtccactctcgttccccaccctcctcctacgtcctacgctcgcgcggcgtcggcacggcgcatacgnnnnnnnnnnnn

SEQ ID NO: 411589 - DNA, 570 bp, Homo sapiens
  misc_feature: GZ8MTXP02GPPZX.17.28.C06.1.454.CMB.2.raw
  modified_base (334)..(334): a, c, t, g, unknown or other
  modified_base (368)..(368): a, c, t, g, unknown or other
  modified_base (401)..(401): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagcctggtccagcctgggggtcctgagactctcctgtgcagcctccggattcccctcagtagttatggatgacttggtccaccagactccgagggaaggggctggagtgggtgccaanataaagcaaagatggaactgcccgtagtttacgngactctgtggagggtccgttcaccatctcaganacaacgccaaagaatcactgtatctaacaactagaaacagcctgaagtgcgacaagaccacgggccgtagtacttacgtgtgacgagtagtaggtaaaggaaaaagtagtggacgttggttagtttaaggtcgggggaccgtaggggaccgtcccgtcggtactacccg

SEQ ID NO: 411590 - DNA, 502 bp, Homo sapiens
  misc_feature: GZ8MTXP02FLAJE.17.28.C06.1.454.CMB.2.raw
  modified_base (362)..(362): a, c, t, g, unknown or other
  modified_base (384)..(384): a, c, t, g, unknown or other
  modified_base (493)..(502): a, c, t, g, unknown or other
tcagcgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatccggccccccgactcctcatctatagaaatgatcatcggccctcgggtccctgaccgattctctggctccatgtctggcacctcagcctccctgacccatcagtggctccggtccgaggatgaggctgattattactgtgcacgtgggatgacntcctgaatggtccgtgtcgggnggagggccaggctgaccgtctagtcagcccaaggctcgccccctggtcactctcgttccccgcccttcctcctagtcctacgctgagcgggctggcaacggcgcatagnnnnnnnnnn

SEQ ID NO: 411591 - DNA, 568 bp, Homo sapiens
  misc_feature: GZ8MTXP02I2KUZ.17.28.C06.1.454.CMB.2.raw
  modified_base (238)..(238): a, c, t, g, unknown or other
  modified_base (519)..(519): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggcagagggtcaccatatcttgttctaggaaacngctccggcatctcaactaaactattttgctggtaccagcaacttcccaggactccggccccccgactcctcatctaatagaaatgatcactccggcccctccggggtccctcgaccccgtattcctctcggcctccgatgtctcggcctaccctcacgccctccctcgacctatccgaggtcgggccctccgggtccgaaggactggagtctagtatttattacgtgtgcaccggtggatgacatcctagagtcggtcggtggttcgggcggtaggaccgnggctacggaccgtcgtaacgtccacgcccgaaggtcctccggtcccccg

SEQ ID NO: 411592 - DNA, 594 bp, Homo sapiens
  misc_feature: GZ8MTXP02GJ2GZ.17.28.C06.1.454.CMB.2.raw
  modified_base (280)..(280): a, c, t, g, unknown or other
  modified_base (306)..(306): a, c, t, g, unknown or other
  modified_base (378)..(378): a, c, t, g, unknown or other
  modified_base (511)..(511): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagccgtggggggtccctgagactctcctgtgcagcctccggattcccccttnagtagttattggatgacttgggtccncagactccgagggaggggctggagtgggtggccaaacataaagcaaagatggaactgccccgtagtttacgnggactctgtaggacggggtccctttacgacctagtcctaccgaaggaacgacaaaccggacccaaagaacttcaactgtactactaacaactagaaacacgcctgagagtcgacagacacggcgtgtattacngtgcgagataggtaaggaaaaagtagtacggcttagtttgtttaagttcgggggactacgggggctcccgtcggtcctacccg

SEQ ID NO: 411593 - DNA, 574 bp, Homo sapiens
  misc_feature: GZ8MTXP02IFMMB.17.28.C06.1.454.CMB.2.raw
  modified_base (377)..(377): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtccagtgtgaggtccagttggttgagtcggggagcctggtccagcctgggggtccctgagactctcctgtgcagccctccggattccccttcagtagttattggatgaattgggtccgccagactccgaggggaaggggctggagtggggtggccaacataaagcaaagatggaactgcccgtagttttacgnggactctgtgagggtcctttcacctatcctcagagacaacgccaaagaacttcaacttgtatctaacaactgaacagcctgagagtcgacagacaggccgtgtattactgtgcgagatggtaagaaaaagtacgtggacttaggttgttttaagttcgggggacctagggggacgtccccgtagggtacctacccgg

SEQ ID NO: 411594 - DNA, 617 bp, Homo sapiens
  misc_feature: GZ8MTXP02IMY4K.17.28.C06.1.454.CMB.2.raw
  modified_base (207)..(207): a, c, t, g, unknown or other
  modified_base (234)..(234): a, c, t, g, unknown or other
  modified_base (347)..(347): a, c, t, g, unknown or other
  modified_base (352)..(352): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtatgtgctgactcagccaccctcagtgtcgtcgggacccccggnagaggtcacatatcttgtctggaaacngctccggcatctacaaactaaactattttgctggtaccagacaattcccgaggactcccggcccccgactcctcatctataagaaatgatcacgtcggcccgtccggggtccngaccncttctcgtgctcatcgtctcgcaccctcaccgtccctcccgtacacctaacgtcgaacggtccggggtccgttcccggggtacccggaagggtactagggacgggtctagttaaatttattaccgtgttacgccgtacggtgggaactcgaactacgtcgtagtaacggttcgggtccgggttgttcgggggacggacggggacctacggggcctacggaccgtacgtaacgaccgacgacccgaacggcctcccgccccgtcgg

SEQ ID NO: 411595 - DNA, 611 bp, Homo sapiens
  misc_feature: GZ8MTXP02FW44B.17.28.C06.1.454.CMB.2.raw
  modified_base (277)..(277): a, c, t, g, unknown or other
  modified_base (302)..(302): a, c, t, g, unknown or other
  modified_base (373)..(373): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagcctggtccagccgtgggggtccctgagactctcctgtgcagcctccggattccccttnagtagttattggatgacttggtccncagactccgagggagggctggagtggtggccaacataaagcaaagatggaaactgccccgtagttttacgnggactctgtagaggggcctttcaccatctacagagacaacgccaaagaattcactgtactactaacaactagaactagcctgaagagtcgacaagaccgaacgggtccgtagttacttacgtggtcgacggtaagagtaggtaaacggaaaaaagttagtaccgggtacttggttaggttttaaaggttcgggggacccgtaaagggggtaccgtccccgtggggtaccctaacccgg

SEQ ID NO: 411596 - DNA, 619 bp, Homo sapiens
  misc_feature: GZ8MTXP02JZ9WA.17.28.C06.1.454.CMB.2.raw
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggcagagggtcaccatatcttgttctggaaacagctccggcatctacaactaaactattttgctggtaccagcaattcccaggactccggcccccgactcctcatctaatagaaatgatcactccggccccgtccggggtccctcgtaccccgattctcgtcggctccatcgtctcggccaccgtcacgtccctccctgaccatcgagtcgggcctccgggtccgaggtatggacgtcttaggtatttacgttacgtggttcgaccgtaccggtggtactacggactacgttccgtagtaacgtcggggttccgggtgggttccggggacggggtacggaccggacggtccgtacggtaccccgtaacgtaacggtaccgacggaccccgaacggtcccgtcccgtccccccgg

SEQ ID NO: 411597 - DNA, 602 bp, Homo sapiens
  misc_feature: GZ8MTXP02GJCBZ.17.28.C06.1.454.CMB.2.raw
  modified_base (382)..(382): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtggggggtccctgagactctcctgtgcagcctccggattcccctcagtagttattggatgacttgggtccgccagactccgaggggaaggggctggagtggggtgaccaacataaagcaaagatggaactgcccgtagttttacgngactctgtgaggggtcctttacacctatcctcagacgacaacgaccaagaattcactgtactctaacaactgaacagcctagagagtcgacagaccgacggccgtgtacttacgtgtgcgtagagtaggtaaggtaaaaagtagtaggtacgttaggtttaggtttaaggttcgggggacccgtagggggtaccgtcccggttacggtaccgtaccccgg

SEQ ID NO: 411598 - DNA, 580 bp, Homo sapiens
  misc_feature: GZ8MTXP02IP5G1.17.28.C06.1.454.CMB.2.raw
  modified_base (485)..(485): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggtgagtccggggagcctggtccagccgtgggggtccctgagactctcctgtgcagcctccggattccccttcagtagtattggatgacttggtccgcagactccgagggagggctggagtggtgccaacataaagcaagatggaaactgcccgtagttttacgtggacttcgtggttagacggggtcctttacgacctatcctaccagtaacgaacaaaccgacaaagtacttcaacttgtactacgtacaaactgaacagacctagagagtcacacgacncggaccgtgtactacgtgtgcgagagtggtaaaggaaaaagtagtacggacttgttagttaaggttgggcgagggactcccggtagtactacccg

SEQ ID NO: 411599 - DNA, 640 bp, Homo sapiens
  misc_feature: GZ8MTXP02G1FTI.17.28.C06.1.454.CMB.2.raw
  modified_base (207)..(207): a, c, t, g, unknown or other
  modified_base (238)..(238): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcggccaccctcagtgtctgggacccccgggnaggagggtcaccatatcttgttctggaaacngctccggcatctacaactaaacatttttgctggtaccagcaattcccaggactccggccccccgactcctcatctatagaaatgatcatccggcccgtccggggtcctgaccgtattcctctggcctccatcgtctggcctacctcgacgccctccctagacccatccgagtcgggtcctcccgggtccgaggtacgtggaggctagtatttagttaactggtcgacctaccgggtaggacttaggacctagttacccgtagtaacgttcggggtcccgggtttcggttccggggacgggtacggggacccgtacggggtaccgtacggtacccggttaccgtaaaggttcccgaaccgggttacccgaaacggtcccgtacccgggtccccctttcccggg

SEQ ID NO: 411600 - DNA, 589 bp, Homo sapiens
  misc_feature: GZ8MTXP02GVFSV.17.28.C06.1.454.CMB.2.raw
  modified_base (268)..(268): a, c, t, g, unknown or other
  modified_base (327)..(327): a, c, t, g, unknown or other
  modified_base (361)..(361): a, c, t, g, unknown or other
  modified_base (497)..(497): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagctgtccagcctgggggtcctgagactctcctgtgcagcctccggattcccctnagtagtattggatgacttggtccgcagactccgagggaggggctggagtgggtgccaanataaagcaagataggaactggccgtagtttacgnggtactctgtaggaacgggtccgtttacacctagtcctaccaagacgaaccaacgaccaaagtaattacactgtaactctaacaactagaacacgacctgagagtcacagacacgggcctgtattactgtagcganagtggaaaggtaaaaagtacgtggtacgtaggttaggtttaagtcgggggacccgagggggtactccccggtggtacccgtaccgtttcccg

SEQ ID NO: 411601 - DNA, 607 bp, Homo sapiens
  misc_feature: GZ8MTXP02GKNJ8.17.28.C06.1.454.CMB.2.raw
  modified_base (281)..(281): a, c, t, g, unknown or other
  modified_base (307)..(307): a, c, t, g, unknown or other
  modified_base (377)..(377): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtgggggtccctgagactctcctgtgcagcctccggattcccccttnagtagttattggatgacttgggtccncagactccgagggaggggctggagtgggtggccaacataaagcaagatggaactgccccgtagtttacgngactctgtgaggggtccttcaccatcctcagacgacaacgaccaagaattcactgtactctaacaactagaacagcctagagagtcgacagtaccgacggtaccgtgttaacttaccgtgtacggacgaagagttggtaaaggtaaaaaagttagtacgggtacttggtttaggtttaaggttcgggggacccgtaagggggacgtcccgttcggggtaccttaccccgg

SEQ ID NO: 411602 - DNA, 642 bp, Homo sapiens
  misc_feature: GZ8MTXP02J1M2D.17.28.C06.1.454.CMB.2.raw
  modified_base (278)..(278): a, c, t, g, unknown or other
  modified_base (305)..(305): a, c, t, g, unknown or other
  modified_base (492)..(492): a, c, t, g, unknown or other
  modified_base (565)..(565): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagcctggtccagccgtgggggtccctgagactctcctgtgcagcctccggattcccccttnagtagttatggatgacttggggtcccnccagaccctccggaaggggacgggtcgtgggagggtgggtacggaccaaacaaagtaaacgacaaagagtacggaacgtcggacccggtttaggttttacggacggtacttcgtggtacgggtaccggggttccttacgacctagtcctaccgaagacgaaccgaaccgacgaagtactactacgtntactactaacagtacgaacgacgtccgtagagacgtacgacgacgaccgacggtaccgtagtactcgtgcganagtagaggtaaacggtaaaagtgtcggacgttgtttagttaaggtcgggacggacggtccgtccgttcgacctcccg

SEQ ID NO: 411603 - DNA, 625 bp, Homo sapiens
  misc_feature: GZ8MTXP02I6X5Y.17.28.C06.1.454.CMB.2.raw
  modified_base (382)..(382): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagcctgtccagccgtgggggtcctgagactctcctgtgcagcctccggacttccccttcagttagttattggatgacgttgggtcccgccagactccgaggggaaggggctggaggtgggtggaccaacaataaagcaaagatggaactgaccccgtagtttacgnggacttcgtggtgaggggtccgtttcacctatctaccagacgacaacgaccaaagaacttcactagtactactaacaactagaacacgcctaggacgtagtcgacaacgaccgaccgggtccgttagttaacttacgtgtacgacggaagtagttaggtaaaggtaaaaagttagttcggacgttggtttaggtttaaggttcgggggaccgtaaggggcgtcccgttagggtccctacccgg

SEQ ID NO: 411604 - DNA, 637 bp, Homo sapiens
  misc_feature: GZ8MTXP02FVQVZ.17.28.C06.1.454.CMB.2.raw
  modified_base (206)..(206): a, c, t, g, unknown or other
  modified_base (236)..(236): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggnagagggtcaccatatcttgttctggaaacngctccgcatctacaaactaactattttgctgtacagctaactcccaggacgtcccggcccccgactcctcactactataagaatgatcacgtccggccccgtcccggggtcctcgaccgtacttcctcgtcgcctccattcgtcgtcgcctacctccaccgtccctccctacgaccctactccgacggtcgggtcccgtcccgggtccgagggtagtcggacgtcgtagtaactttacgttacgtcggtcgccgtacgggtaggtacgtcgactacgtcgtagtacggttcggggttccggttcgggttcggggacgggtacgggaccgtacgggtccgtaccggtacccgtaccgtaacgccgacggtaccccgacggtcccgtcccggtcccccgtcgg

SEQ ID NO: 411605 - DNA, 584 bp, Homo sapiens
  misc_feature: GZ8MTXP02HL7A4.17.28.C06.1.454.CMB.2.raw
  modified_base (348)..(348): a, c, t, g, unknown or other
  modified_base (384)..(384): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggttgagtccggggagcctggtccagccgtgggggtccctgagactctcctgtgcagcctccggacttcccctcagtagttattggatgacttgggtccgccagacctccgaggggaaggggctgggaggtggggtggaccaaanaataaagcaaagataggactgcccgtagttttacgnggactgtgtagacggggtccgtttacacctatcctaccagacgaacacgaccaaagatacatagtatctaacaactagaacacgctagagtagtcgacagacgtacggccgtagtattactgtgacgagagtaggaagtaaaaagtatggattgttagtttaaggtcgggacgtagggacgtcccgtggttaccgtaccg

SEQ ID NO: 411606 - DNA, 615 bp, Homo sapiens
  misc_feature: GZ8MTXP02GH9BB.17.28.C06.1.454.CMB.2.raw
  modified_base (268)..(268): a, c, t, g, unknown or other
  modified_base (292)..(292): a, c, t, g, unknown or other
  modified_base (367)..(367): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtcagtgtgaggtcagttggtgagtcgggagctggtccagccgtgggggtcctgagctctctgtgcagcctccggattcccctnagtagttatggatgacttggtccnccagactccgagggaggggctggaggtgggtggaccaacataaagcaaagatggaactgacccgtagttttacgngtactcgtgtgagggtcctttacaccgtatcctacgagacgaacacgaccaaagaacttcgacttagtactactaacaactagaacacgacctgagagtcgacgaacgaaccgaccgggtccgtagttacttacgtggtacgacggtaagtagttaggtaaaggtaaaaagttagtaggtacgttggtttagtttaaggtttacgggggcctaacgggggtacgtccccggtagggtccctaccccgg

SEQ ID NO: 411607 - DNA, 550 bp, Homo sapiens
  misc_feature: GZ8MTXP02I70BR.17.28.C06.1.454.CMB.2.raw
  modified_base (375)..(375): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagcctggggggtccctgagactctcctgtgcagcctccggattcccctcagtagttattggatgacttgggtcccgccagactccagggaaggggctggagtgggtgccaacataaagcaagatggaactgccccgtagtttacgnggactctgtgaggggcctttcaccatcctacagagacaacgccaagaattcactgtatctaacaactagaacagcctagagagtcgacaagacacggcgtgtattactgtgcgagatggaggaaaaagtactggactgttagttaagtcggggacagggactccgtggtactccg

SEQ ID NO: 411608 - DNA, 600 bp, Homo sapiens
  misc_feature: GZ8MTXP02FWGAN.17.28.C06.1.454.CMB.2.raw
  modified_base (379)..(379): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtggggggtccctgagactctcctgtgcagccctccggattcccccttcagtagttattggatgacttgggtccgccagactccgaggggaaggggctggaggtgggtggccaaacataaaagcaagatggaactgccgtagtttacgngactctgtgaagggtccgttcaccatcctccagagacaacgccaaagaattcatgtactctaacaactgaacagcctagagagtcgacagacgacggccgttagtacttacgtgtgcgagagttaggtaaaggaaaaaagttaagtcggtacgttaggtttaggtttaggttcgggggacctaagggggacctccccggtgggtaccctacccggttcccg

SEQ ID NO: 411609 - DNA, 659 bp, Homo sapiens
  misc_feature: GZ8MTXP02JVYU0.17.28.C06.1.454.CMB.2.raw
  modified_base (208)..(208): a, c, t, g, unknown or other
  modified_base (521)..(521): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggnaggagggtcaccatatcttgttctaggaaacagctccggcatctacaaactaaactattttcgctggtaccagcaacttcccaggactcccggcccccactcctcatctaatagaaatgatcatccggcccgtccggggtccctagaccccgtattctcgtggcctcctagtgtccgtggacctacctccgacgtcccctcccgtcgaaccctagtcccgtacgggtcggggcccgttcccggggtccggaggtacgtggacggtctaggtactttattacgtgtcgccgtaacggttgggaactcggtaacncgttccgtaggtacgtcggggttccggttggggttccgggacggggtacggaaccgtcgggtacgttaccggacccgggtttaaccgaaacggttccgaaccggtacccggaacgggtcccgtacccggtccccccgg

SEQ ID NO: 411610 - DNA, 555 bp, Homo sapiens
  misc_feature: GZ8MTXP02GES8V.17.28.C06.1.454.CMB.2.raw
  modified_base (374)..(374): a, c, t, g, unknown or other
  modified_base (450)..(450): a, c, t, g, unknown or other
  modified_base (482)..(482): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccgaggggaaggggctggagtgggtggccaacataaaagcaagatggaactgccgagttttacgnggactctgtgaagggtccgtttcaccatcctccagagacaacgccaaagaattcactgtatctaacaactgaaacngcctgagagtcgcagacacggcgtgtattacngtgcgagataggtaaggaaaaagtagtggcttgtgtttacgtggggccaggggacgcccgtggtccaccgtcc

SEQ ID NO: 411611 - DNA, 597 bp, Homo sapiens
  misc_feature: GZ8MTXP02IJ4WB.17.28.C06.1.454.CMB.2.raw
  modified_base (380)..(380): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgtttttagaaggtgtccagtgtgaggtccagttggttgagtcgggggagcctggtccagccgtgggggtccctgagactctcctgtgcagcctccggattccccttcagtagttattggatgacttgggtccaccagactccgaggggaaggggcgtggaggtggggtgaccaacataaagcaagatggaactgcccgtagtttacgnggactctgtgaggggtcctttcacctatcctacaagacgaacaacgaccaaagacttacactagtactactaacaactacgaacacgcctaggagtacgtcgacgacgaccgacggccgttagtattactgtgcgagtataggtaaggaaaaagtagtgggtacttggttagtttaaggttcgggggacgaggggtacgcccgtaggtacctacccg

SEQ ID NO: 411612 - DNA, 610 bp, Homo sapiens
  misc_feature: GZ8MTXP02HC078.17.28.C06.1.454.CMB.2.raw
  modified_base (388)..(388): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagccgtgggggtccctgagactctcctgtgcagcctccggattccccttcagtagttattggatgacttgggtcccgcagacctccgaggggaaggggctgggaggtggggtggaccaaacgataaagcaaagatggaactgaccccgtagttttacgnggactcgtgtgacggggtccgtttcaccgtatcctaccgagacgaacaacgcccaaagtaacttcactgtactactaacaactagaacagcctagagagtcgacagacgacggtccgtagtacttacgtgtgcgagtatggtaaggtaaaaagtacgtaggtcttaggtttaggtttaagttcgggggaccgtaggggacgtccccgtaggtaccgtacccg

SEQ ID NO: 411613 - DNA, 589 bp, Homo sapiens
  misc_feature: GZ8MTXP02IFC1D.17.28.C06.1.454.CMB.2.raw
  modified_base (387)..(387): a, c, t, g, unknown or other
  modified_base (412)..(412): a, c, t, g, unknown or other
  modified_base (422)..(422): a, c, t, g, unknown or other
  modified_base (460)..(460): a, c, t, g, unknown or other
  modified_base (468)..(468): a, c, t, g, unknown or other
  modified_base (478)..(478): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggtttttcttgttgctgttttagaaggtgtccagtgtgaggtccagttggttgagtccgggggagcctggtccagccgtggggggtccctgagactctcctgtgcagcctccggactttcccccttcagttagttattggatgactttgggtccgccagactccgaggggaaggggcgtgggagtggggtggccaaacaataaaagcaaagataggaactgccgtagttttacgnggactctgtgaagggccgtttcacntcctccaganacaacgccaaagattcacttgtatctacaactgaaacngcctgagngtcgcagacncggccgtatattactgtgacgaagtagtaggtaaggtaaaatagtcggtacttggtttagtttaggtcggggccgtaagggggacctcccggtcggtacctaccggttccc

SEQ ID NO: 411614 - DNA, 579 bp, Homo sapiens
  misc_feature: GZ8MTXP02GHWZB.17.28.C06.1.454.CMB.2.raw
  modified_base (374)..(374): a, c, t, g, unknown or other
  modified_base (379)..(379): a, c, t, g, unknown or other
  modified_base (404)..(404): a, c, t, g, unknown or other
  modified_base (421)..(421): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggagctggtccagcctgggggtccctgagactctcctgtgcagcctccggattccccttcagtagttattggatgacttggtccgcagactccgagggaaggggctggaggtgggtggaccaacataaagcaaagatggaactgccccgtagtttacgngactntgtgagggtccttcacatctcaganacacgccaagattcatnatctacaatagaacagcctagagagtcgacaagaccgacggccgtgttaacttactgtgcgaagtagtaggtaaaggaaaaagttagtggtacttaggtttggtttaaggttcgggggacccgaagggggtcgtccccggttgggtaccctaccccgg

SEQ ID NO: 411615 - DNA, 595 bp, Homo sapiens
  misc_feature: GZ8MTXP02F6765.17.28.C06.1.454.CMB.2.raw
  modified_base (345)..(345): a, c, t, g, unknown or other
  modified_base (382)..(382): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagcctggtccagccgtgggggtccctgagactctcctgtgcagcctccggattcccccttcagttagttattggatgacttgggtccgccagactccgaggggaaggggctggagtgggtggaccaanagtaaagcaaagatggaactgaccccgtagtttacgnggactgtgtgacgggtccgtttcaccgtatcctaccagacgacaaccgaccaagaattcgatgtactactaacaactagaacagcctagagagtcgacagaccacgggtccgtagtacttacgtgtgcgtagagtagtaaggtaaaaagtagtaggacgttggtttagttaagttcggggacctaggggacgacccgttcgggtcctacccgg

SEQ ID NO: 411616 - DNA, 560 bp, Homo sapiens
  misc_feature: GZ8MTXP02GUB0W.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgcagactccagggaggggctggagtgggtgccaacataaagcaagatggaaactgccccgagtttacgtggactctgtgagggcctttcaccatctccagagacaacgccaagaattcactgtatctaacaactagaacagcctgagagtcgcagacacggccgtgtacttactgtgcgagatggtaggaaaaagtatagggcttggttagtttaagttgggggaccgaggggacgcccgttagggtctacccgg

SEQ ID NO: 411617 - DNA, 564 bp, Homo sapiens
  misc_feature: GZ8MTXP02J1WYZ.17.28.C06.1.454.CMB.2.raw
  modified_base (372)..(372): a, c, t, g, unknown or other
  modified_base (491)..(491): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggtgagtccggggagcctggtccagccgtgggggtccctgagactctcctgtgcagcctccggattcccccttcagtagttattggatgacttgggtccgccagactccgagggaggggctggagtgggtggcaacataaagcaagatgaactgccccgtagtttacgnggactcgtgtgacggggtccgtttcacctatcctccaagacgaacaaccgaccaagaattacactgtatctaacaactagaacacgcctgagagtcgcagacacggcgtgtattactgngtcgagataggtaggaaaagtagtagcgtgttagttaagttcgggccgagggacgcccgtacggtcgtacccg

SEQ ID NO: 411618 - DNA, 651 bp, Homo sapiens
  misc_feature: GZ8MTXP02HRCMT.17.28.C06.1.454.CMB.2.raw
  modified_base (278)..(278): a, c, t, g, unknown or other
  modified_base (379)..(379): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggttttccttgttgcttgttttagaaggtgtccagtgtgaggtccagttggttgaggtccggggagcctggtccagccgtgggggtccctgagactctcctgtgcagcctccggattcccctnagtagttattggatgacttggtccgccagctccgagggaggggctggagtggtggaccaaacataaaagcaaagataggaactgaccccgtagttttacgnggactctggtgacgggtccgtttacacctatcctaccgaagacgaccaaacgacccaagtaacttcaacttgtactactaacaactagaacacggtcctagagtacgtcgacagaccgacgggccgttagttacttacgtggtgacggaggtaattagggtaaaacgggtaaaaagttacgtaggggtactttagggtttaggtttttaagggttacggggggacccgtagggggtaacccgtccccggtttacgggtacccgtaaccccgg

SEQ ID NO: 411619 - DNA, 564 bp, Homo sapiens
  misc_feature: GZ8MTXP02GWRB1.17.28.C06.1.454.CMB.2.raw
  modified_base (375)..(375): a, c, t, g, unknown or other
  modified_base (410)..(410): a, c, t, g, unknown or other
  modified_base (513)..(513): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctgggggtccctgagactctcctgtgcagcctccggattccccttcagtagttattggatgacttgggtccgccagactccagggaaggggctggagtgggtggccaacataaagcaagatggaactgccccgtagtttacgnggactctgtgagggtccgtttcaccatctccaganacaacgccaaagaattcactgtatctaacaactagaacagcctagagagtacgcagacacggccgtgtattactgtgcgagatggtaggaaaaagtagtcggnttggttagtttaagttgggggccgaggggacgtcccgtgggtcctacccgg

SEQ ID NO: 411620 - DNA, 567 bp, Homo sapiens
  misc_feature: GZ8MTXP02G024V.17.28.C06.1.454.CMB.2.raw
  modified_base (374)..(374): a, c, t, g, unknown or other
  modified_base (458)..(458): a, c, t, g, unknown or other
  modified_base (479)..(479): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctgggggtccctgagactctcctgtgcagcctccggattccccttcagtagttattggatgacttgggtccgccagactccgagggaggggctggagtgggtgccaacataaagcaagatggaactgacccgtagtttacgngactcgtgtgaggggtcctttcaccatctccagagaccaacgccaagatcactgtatctacaactgaacagcctgagagtcganagaccacggccgtgtaattcngtgcgagatggtaaggaaaaatagtgggtacttggttagtttaagtcgggggaccgtaggggacgtccccgtggggtaccctacccgg

SEQ ID NO: 411621 - DNA, 626 bp, Homo sapiens
  misc_feature: GZ8MTXP02H3VK0.17.28.C06.1.454.CMB.2.raw
  modified_base (381)..(381): a, c, t, g, unknown or other
  modified_base (472)..(472): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggagcctggtccagcctgggggtccctgagactctcctgtgcagcctccggacttccccttcagtagttattggatgacttgggtccgccagacctccgaggggaaggggctggaggtggggtggaccaaacataaagcaagagtggactgcccgtagttttacgnggactcgtgtagagggtcctttacacctatcctacagacgacaacgccaaagattcacttgtactacacaaactgaaacacgcctgaacgngtacgacgacgacgaccggtccgttagtaatttaccgtggtgacggagtaagttagggtaaacggtaaaaaggttaatcggggtactttagggttaggtttttaaggttcgggggactacgggggtacctccccggttagggttccctacccgg

SEQ ID NO: 411622 - DNA, 588 bp, Homo sapiens
  misc_feature: GZ8MTXP02F6ACH.17.28.C06.1.454.CMB.2.raw
  modified_base (339)..(339): a, c, t, g, unknown or other
  modified_base (376)..(376): a, c, t, g, unknown or other
  modified_base (409)..(409): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggttgagtcggggagctggtccagcctgggggtccctgagactctcctgtgcagcctccggattccccttcagtagttattggatgacttgggtccgcgagactccgagggaaggggctggagtgggtggaccaanataaagcaaagactggaactgccccgtagttttacgnggactctgtgagggccgtttcacatctccaganacaacgccaagaattcaactagtatctaacaactacgaacagccttagacgagtcgaccaagaccacggaccgtagtacttacgtgtcgagagataggtaaggtaaaaagtaagtcggtacgtagttagtttaacggttagggggccgagggggtacgcccgttgggtacctaacccgg

SEQ ID NO: 411623 - DNA, 591 bp, Homo sapiens
  misc_feature: GZ8MTXP02HQRP3.17.28.C06.1.454.CMB.2.raw
  modified_base (238)..(238): a, c, t, g, unknown or other
  modified_base (292)..(292): a, c, t, g, unknown or other
  modified_base (497)..(497): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggaccccggcaggagggtcaccatatcttgttctaggaaacngctccggcatctacaaactaaactattttgctggtaccagcaattcccaggacncccggcccccactcctcatcatagaatgatcagtccggccccgtccggggccctcgaccccgtattccgtctcggcttccagtcgtcgtcggacctaccctccacgccccttcccgcgaaccacgttcgaggtccggggcccttccgggtaccgaaggtctggacgtctagttattacttacgtgtcgacctacggtggatgacntacgtagacgtcggtcgtggttcgggcgacggacgacggtctaccggacccgtaacgtacgaccgacgacccgtaacgcccgtccgtcccccgg

SEQ ID NO: 411624 - DNA, 577 bp, Homo sapiens
  misc_feature: GZ8MTXP02HZTQ6.17.28.C06.1.454.CMB.2.raw
  modified_base (379)..(379): a, c, t, g, unknown or other
  modified_base (385)..(385): a, c, t, g, unknown or other
  modified_base (400)..(400): a, c, t, g, unknown or other
  modified_base (572)..(572): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggagcctggtccagccgtgggggtcctgagactctcctgtgcagcctccggacttccccttcagtagttattggatgacttgggtccgccagactccgagggaggggctggagtgggtgccaacataaagcaaagataggaactgaccccgtagttttacgnggactntgtgagggccgtttnaccatctcagacacaacgccaaagaattcaacttgtactactaacaactagaacagcctgagagtcgacagacacggcgtagtattactgtgacgagagtaggtaaggaaaaagtagtacggtcttgttagtttaaggttggggaccgtaggggacgtcccgtaggttaccncccgg

SEQ ID NO: 411625 - DNA, 616 bp, Homo sapiens
  misc_feature: GZ8MTXP02HE08P.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggtgagtcggggagcctggtccagccgtgggggtccctgagactctcctgtgcagcctccggacttccccttcagtagttatggatgactgggtccgccagactccgagggaaggggctggagtgggtcggaccaacgataaagcaaagataggaactgccccgtagtttacgtggacttcgtgtgagggtccgtttacacctatcctaccagacgacaacgaccaaagaacttacactgtaactctaacaactgaaacacgcctagacgtagtaccgacgaagaccgaacgggtcccgttagtacgttactggtacgcggtaagtagttaggtaaaggtaaaaaagtagtagggtacttggttagtttaaggttacggggacgtacggggactcccggtggtacctacccgg

SEQ ID NO: 411626 - DNA, 577 bp, Homo sapiens
  misc_feature: GZ8MTXP02IR5IB.17.28.C06.1.454.CMB.2.raw
  modified_base (373)..(373): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttgtgagtcggggagctggtccagccgtgggggtcctgagactctcctgtgcagcctccggacttcccctcagtagttattggatgacttgggtccgccagacctccgagggaaggggctggaggtgggtgccaacataaagcaaagatggaactgacccgtagtttacgnggactctgtgagggtcctttcacctatctcagagaacaacgaccaaagaattcactgtactactaacaactagaacagcctaggagagtcgacagacgacggccgtagtacttacgtgtgcgagataggtaacggaaaagtagtaggtacgttgttagtttaacggttggggaccgtacggggacgcccgtacggtctacccgg

SEQ ID NO: 411627 - DNA, 592 bp, Homo sapiens
  misc_feature: GZ8MTXP02G6GQJ.17.28.C06.1.454.CMB.2.raw
  modified_base (208)..(208): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggnagagggtcaccatatcttgttctggaaacagctccggcatctacaactaaactattttgctggtaccagcaattcccaggactccggccccccgatcctcatctatagaaatgatcatccggccctccggggtccctgaccccgattctctcggctccatgtctggccacctcacgccctccctgacctatcgaggtcgggcccttccgggtccgaggtacgtgaggtctagtaatttagttacgtgtcgccgaccggtggtatgaacgtactcccgtagaacgtcgggttcgggttcggttcggggacgggtacgggaccgacgggtccgtcgtaacccgtccgtaaagtaccgacggtcccgaacggtccgtccgtcccccg

SEQ ID NO: 411628 - DNA, 571 bp, Homo sapiens
  misc_feature: GZ8MTXP02JVJWR.17.28.C06.1.454.CMB.2.raw
  modified_base (306)..(306): a, c, t, g, unknown or other
  modified_base (377)..(377): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctgggggtccctgagactctcctgtgcagcctccggattcccccttcagtagttattggatgacttgggtccnccagacctccagggaaggggctggagtgggtggccaacataaagcaagatggaactgccccgagtttacgnggactctgtgagggccgtttcacctatctccagagacaacgccaagattcactgtatctaacaactgaaacagccctgagagtcgcagacaccgggcgtagattacgtgtgcgtagatggaggaaaaaagtagtacggcttaggttggtttaagtcgggggtaccagggggtacgtcccgtggtacctaccccg

SEQ ID NO: 411629 - DNA, 552 bp, Homo sapiens
  misc_feature: GZ8MTXP02F6EOG.17.28.C06.1.454.CMB.2.raw
  modified_base (370)..(370): a, c, t, g, unknown or other
  modified_base (482)..(482): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggctggtccagcctgggggtcctgagactctcctgtgcagcctccggattccccttcagtagttattggatgacttgggtccgccagactccgaggggaagggctggagtggggtggccaacataaaagcaagatggaactgccgagttttacgngactctgtgaagggccgtttcaccatctccagagacaaacgccaaagaattcactgtatctaacaactgaaacagacctgaagagtcgcaagacaccggccgtagtattacngtgcgagatgtaggaaaaagtaagtggctgtgtttaagtggggcaggggactcccgtggtccaccgttcc

SEQ ID NO: 411630 - DNA, 585 bp, Homo sapiens
  misc_feature: GZ8MTXP02GAIRB.17.28.C06.1.454.CMB.2.raw
  modified_base (277)..(277): a, c, t, g, unknown or other
  modified_base (302)..(302): a, c, t, g, unknown or other
  modified_base (378)..(378): a, c, t, g, unknown or other
  modified_base (416)..(416): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagcctggtccagccgtgggggtccctgagactctcctgtgcagcctccggacttccccttnagtagttatggatgacttgggtccnccagactccgagggaggggctggagtgggtggaccaacaataaagcaaagataggaactgccccgtagttttacgnggactcgtgtgaggggcctttcacctatcctaccaganacaaacgccaaagaattcatagtatactaacaactagaacagcctgacgagtcgacagaccgacggccgtagtattactgtgacggaagtagtagtaaaggaaaaagttagtacggtacttggttagtttaagtcggggaccgaggggacgcccgtgggtacctaccgg

SEQ ID NO: 411631 - DNA, 600 bp, Homo sapiens
  misc_feature: GZ8MTXP02JNIHP.17.28.C06.1.454.CMB.2.raw
  modified_base (346)..(346): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagccgtgggggtccctgagactctcctgtgcacgcctccggattccccttcagtagttattggatgtacttggtccgccagacctccgaggggaaggggctggagtgggtggccaaanataaagcaaagatggaactgaccccgtagtttacgtgactctgtgagggtccgtttcaccgtatctcagacgaacaacgaccaaagacttacactagtactactaacaactagaacagccctagaacgtagtacgacaagaccgacggccgttagtaacttaccgtgtcgacgtaggtataggtaaaggaaaagttagtgacgtttgtagtttaaggtcggggaccgaggggacctcccgtggtaccgtacccg

SEQ ID NO: 411632 - DNA, 513 bp, Homo sapiens
  misc_feature: GZ8MTXP02GPROD.17.28.C06.1.454.CMB.2.raw
  modified_base (362)..(362): a, c, t, g, unknown or other
  modified_base (496)..(496): a, c, t, g, unknown or other
  modified_base (503)..(513): a, c, t, g, unknown or other
tcagcgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgatcctcatctatagaaatgatcatcggccctccgggtccctgaccgattctctggctccatgtctggcacctcagcctcccctgaccatcagtgggctccggtccgaggatgaggctgattatactgtgcaccgtgggatgacntcctgaatggtccgtgtcgggcggaggaccaggctgaccgtcctaagtcagcccgaagcctcgccccctcggtccaccttctcgttccccgccctccctctacgtctacgctcgacgcgggctggcaagggccngactagnnnnnnnnnnn

SEQ ID NO: 411633 - DNA, 605 bp, Homo sapiens
  misc_feature: GZ8MTXP02GUWFD.17.28.C06.1.454.CMB.2.raw
  modified_base (333)..(333): a, c, t, g, unknown or other
  modified_base (340)..(340): a, c, t, g, unknown or other
  modified_base (377)..(377): a, c, t, g, unknown or other
  modified_base (418)..(418): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagctggtcagccgtgggggtcctgagactctcctgtgcagcctccggacttccccttcagtagttattggatgtacgttgggtccgccagacctccgagggaggggctggagtgggngaccaanataaagcaaagataggaactgacccgtagttttacgnggtactctggtagacggggtcctttacacctatctaccganacgacaacgaccaaagaacttcacttgtactactaacaactagaacagcctagagtagcacgacacgacggcgtagtattacgtgtgacgtagtagtaggaaagggtaaaaagttagtcggtacgttaggtttagtttaaggttcgggggacgtacgggggactccccggttaggtaccctaccccg

SEQ ID NO: 411634 - DNA, 541 bp, Homo sapiens
  misc_feature: GZ8MTXP02JWT1B.17.28.C06.1.454.CMB.2.raw
  modified_base (379)..(379): a, c, t, g, unknown or other
  modified_base (479)..(479): a, c, t, g, unknown or other
  modified_base (499)..(499): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctgggggtccctgagactctcctgtgcagcctccggattccccttcagtagttattggatgacttggtccgccagactccgagggaaggggctggagtgggtggccaaacagtaaagcaaagatggaactgccccgtagtttacgnggactctgtgagggccgttcaccatctcagagacaacgccaagattcactgtatctaacaactgaacagcctagagagtcgcagacacggctgtacttangtgcgagatgagaaaagtanggcttgtgttaagtgggggaccagggacgcccgtggctaccg

SEQ ID NO: 411635 - DNA, 628 bp, Homo sapiens
  misc_feature: GZ8MTXP02HPY36.17.28.C06.1.454.CMB.2.raw
  modified_base (274)..(274): a, c, t, g, unknown or other
  modified_base (300)..(300): a, c, t, g, unknown or other
  modified_base (388)..(388): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgttttagaggtgtcagtgtgagtcagttggtgaggtcggggagctggtcagccgtgggggtcctgagctctctgtgcacgcctccggtacttcccccttnagtagttattggatgacttgggtccncagacctccgaggggaaggggctagggaggtggggtggaccaaaacaataaaagcaaagataggaactggaccccgtagtttttacgnggacttcgtggtaggtacggggtcctttcaaccgtattccacaagacgaacaaacgaccaaagtaactcacttagtatactaacaactagaaacacgcctagagtacgcgacaagaccgacggccgttagtacgttactggtgacgtagaagttaggaaaggtaaaaagtacgttgacgtttagttaggttttaacggtgggggtacctagggggtaccgtcccgtaggttaccgtcccg

SEQ ID NO: 411636 - DNA, 594 bp, Homo sapiens
  misc_feature: GZ8MTXP02HU299.17.28.C06.1.454.CMB.2.raw
  modified_base (303)..(303): a, c, t, g, unknown or other
  modified_base (383)..(383): a, c, t, g, unknown or other
  modified_base (511)..(511): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggagcctggtccagccgtgggggtcctgagactctcctgtgcagcctccggattccccttcagtagttattggatgacttggtccnccagactccgagggaggggctggagtgggtgaccaaacagtaaaagcaaagataggaaactgaccccgtagttttaccgnggacttctggtagacggggtcctttcacctatcctcagacgaacaaacgccaaagaactcaacttagtactctaacaactagaaccagcctagacgagtcgacaacgacgacggccgtatacttacgngtcgcgaagtatagggtaaagaaaaacgttatcgacgttggttagtttaagtcggggacctaggggactcccgtgtcctaccg

SEQ ID NO: 411637 - DNA, 569 bp, Homo sapiens
  misc_feature: GZ8MTXP02J3QQF.17.28.C06.1.454.CMB.2.raw
  modified_base (277)..(277): a, c, t, g, unknown or other
  modified_base (374)..(374): a, c, t, g, unknown or other
  modified_base (475)..(475): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggttttccttgttgctgttttagaaggtgtccagtgtgaggtccagttggttgagtccgggggagcctggtccagcctggggggtccctgagactctcctgtgcagcctccggattcccctnagtagtattggatgacttgggtccgccagactccgaggggaaggggctggagtggtgaccaacataaagcaagatggaactgccccgagttttacgnggactctgtgaggggtcctttcacccatctccagagacaacgccaagattcactgtatctacaactgaacagcctgagagtcgacaacgacgacggtcgtntaacgttctaggtcgaggatagttaggtaaaaggtaaaaagtgtcggtcttagttgttttaaggcggacgacggcctccgttcgacccttcccg

SEQ ID NO: 411638 - DNA, 575 bp, Homo sapiens
  misc_feature: GZ8MTXP02FVDUJ.17.28.C06.1.454.CMB.2.raw
  modified_base (279)..(279): a, c, t, g, unknown or other
  modified_base (303)..(303): a, c, t, g, unknown or other
  modified_base (412)..(412): a, c, t, g, unknown or other
  modified_base (456)..(456): a, c, t, g, unknown or other
  modified_base (484)..(484): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgaggtcggggagctggtccagccgtgggggtccctgagactctcctgtgcagccctccggacttcccccttnagtattatggatgacttgggtccnccagactccgaggggaggggctggaggtgggtgaccaacataaagcaaagatggaactgcccgtagttttactggactcgtgtgacgggtcctttcactatcctcaganacacgacaagaattcatgatactacaactagaacagacctgagngtcgacacgacacggtcgtgtacttacngtgcgtagataggtaaaggaaaaatagtacggtcttggttaggtttaaggttcgggggacgtaggggtaccgtcccgtggtaccgtacccg

SEQ ID NO: 411639 - DNA, 647 bp, Homo sapiens
  misc_feature: GZ8MTXP02HB3J5.17.28.C06.1.454.CMB.2.raw
  modified_base (302)..(302): a, c, t, g, unknown or other
  modified_base (384)..(384): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgcttgttttagaaggtgtccagtgtgaggtcagttggtgagtccggggagcctggtccagccgtgggggtcctgagactctcctgtgcagcctccggacttccccttcagtagttattggatgacttggtccnccagacctccgaggggaaggggctggagtggggtggccaaacataaaagcaaaggataggaactgaccccgtagttttacgnggtacttctggtaggaggggtcccgtttcacctactcctacccgaagacgaaaccaaacgacccaaagtaacttcaacttgtaactctaacaaactagaaacagcctaggagtaagtcacaagaccaacgggccgttaggtaattaccgtgtcgacgaaggtagttaggtaaaagggtaaaaaaggttacgtacgggacgttaggtttagtttaaggttcgggggaccggtaggggaaccgtcccggtcggtttacgaccccg

SEQ ID NO: 411640 - DNA, 677 bp, Homo sapiens
  misc_feature: GZ8MTXP02IL109.17.28.C06.1.454.CMB.2.raw
  modified_base (274)..(274): a, c, t, g, unknown or other
  modified_base (383)..(383): a, c, t, g, unknown or other
tcagcgtagactagcacgaccggtgctcgatttagagctcacgtattgggtttggggctcagagaggaggcttagccctggactccaaggccttttccacttggtgatcagcactgagcacagaggactcaccatggagttggggctgaactgggttttccttgttgctgttttagaaggtgtccagtgtgaggtccagttggttgaggtcggggaggctggccagccgtgggggtcctgagactctcctgtgcagcctccggacttccccttnagttagttattggatgtacgttgggtccgccagaccgtccgaggggaaggggctgggagtggggtggaccaaacataaaagcaaagataggaactgccgtagtttacgngactctgtggaacgggtccgtttcacctatcctaccagaacgaaccaaacgaccaaagtaattcaacgttagtacttcctaaacaactagaaaccagtaccctagaacgacggttccgacgaacggaaccgtaccggggccgtttaggttaactttacgtggttacggacgtaagtaagttaggtaaaagggaaaaaagtttaagtacgggttcgtttaggtttaggttttaacggtcgggggtacccgtaagggggtaccgtcccgtttacggggtccctaaccggtttcccg

SEQ ID NO: 411641 - DNA, 604 bp, Homo sapiens
  misc_feature: GZ8MTXP02FR0AU.17.28.C06.1.454.CMB.2.raw
  modified_base (373)..(373): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctgggggtccctgagactctcctgtgcagcctccggattccccttcagtagttattggatgacgttgggtccgccagacctccgaggggaaggggctggagtgggtggccaacataaaagcaagatgaactgccgtagtttacgngactctgtgaagggtccgttcaccatcctccagacgacaacgccaaagatcactgtatctaacaactgaaacagcctagagagtcgacaagacaccgggccgtagttactactgtagacgagagttggtaaaggtaaaaacgtagtaggacgtttaggttaggtttttaaggtgggggacccgtaagggggtaaccgtccccgttaggggtacccctaaccggtttccccg

SEQ ID NO: 411642 - DNA, 716 bp, Homo sapiens
  misc_feature: GZ8MTXP02G91XT.17.28.C06.1.454.CMB.2.raw
  modified_base (376)..(376): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagccctccggattccccttcagtagttattggatgtacttgggtcccgcagactccgaggggaggggctggagtgggtggccaacataaagcaagatggaactgcccgtagtttacgnggactcgtgtggacggggtcctttacgacctatcctaccaggacaaccgaaaccgacccgaaagtaacttaccaacttagtaacttacctaaaccctaaaccttacggaaacctaacggtccccgttaggaacgggtacggtaccggaccgaacggtaacccgaccggggtaccccggtttaggttaaacttttaccgtgggttacggaccggtaaggtacgtttagggtaaaaggggtaaaaaaacgttacgttacgggtacgtttagggtttagttttaagggttcgggggacccggtaggggtacccggtcccgttacgggtcccgttaacccccgg

SEQ ID NO: 411643 - DNA, 603 bp, Homo sapiens
  misc_feature: GZ8MTXP02FSCO0.17.28.C06.1.454.CMB.2.raw
  modified_base (276)..(276): a, c, t, g, unknown or other
  modified_base (300)..(300): a, c, t, g, unknown or other
  modified_base (373)..(373): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggagctggtccagccgtgggggtccctgagactctcctgtgcagcctccggacttcccctnagtagttatggatgacttggtccncagactccgagggaaggggctggagtgggtggccaacataaagcaaagatggaaactgccccgtagtttacgnggactcgtgtgacggggtccgtttcaccatcctacaagacgacaacgaccaaagaattcaactgtactactaacaactagaacagcctagagagtcgacgaagaccgacggccgtagttacttacgtgtgacgtaagagtaggtaaaggaaaaagttaacgtagggtacttaggttaggtttaaggttcgggggaccgtacggggtacgtcccgtcggtacctaacccgg

SEQ ID NO: 411644 - DNA, 593 bp, Homo sapiens
  misc_feature: GZ8MTXP02GZNCR.17.28.C06.1.454.CMB.2.raw
  modified_base (325)..(325): a, c, t, g, unknown or other
  modified_base (398)..(398): a, c, t, g, unknown or other
  modified_base (458)..(458): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagcctggtccagcctgggggtccctgagactctcctgtgcagccctccggattccccttcagtagttattggatgacttggtccgcagactccgagggaaggggctggnggtggtggccaacataaagcaagatggaactgccccgtagtttacgtgactgtgtggagggtccgtttcaccntctcagagacacgcaagaatcatgtactactaacaactgaacagccgtagagtagtcganaacgacgacggtccgtagtacttacgtgtcgacgtagagttaggtaaaggtaaaaagtaagtcggtacttgggtttagtttaaggttcgggggacccgagggggtaaccgtcccggttcgggtaccttaccccgg

SEQ ID NO: 411645 - DNA, 614 bp, Homo sapiens
  misc_feature: GZ8MTXP02IQX5W.17.28.C06.1.454.CMB.2.raw
  modified_base (378)..(378): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctgggggtccctgagactctcctgtgcagcctccggattccccttcagttagttattggatgacttggggtccgccagactccgaggggaaggggctgggaggtgggtggccaacataaaagcaagatggaactggccgtagttttacgnggactctgtggaagggtccgtttacacctatcctaccagacgaaccaacgccaaagaacttcaactatatctaacaactgaacagcctgagagtcgacagacacggcctagtattactgtgacgagtagtaggtaaggaaaaagttagtacggtacgttaggtttaggttttaaggttcgggggtaccgaacgggggtaccgtacccggttcgggttacccgtacccggtttcccg

SEQ ID NO: 411646 - DNA, 651 bp, Homo sapiens
  misc_feature: GZ8MTXP02JQ8QH.17.28.C06.1.454.CMB.2.raw
  modified_base (379)..(379): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtggggggtccctgagactctcctgtgcagcctccggattcccctcagtagttattggatgacttgggtccgccagactccgagggaggggctggagtgggtggccaacataaagcaaagatggaaactgccccgtagtttacgnggactctgtgacggggtccgtttcaccatcctccagagacacgccaaagatcactgtatctaacactagaacagcctagacgagtcgacaagaccgacgggcccgttaggtaactttaccgtggttacggacgtaaggtaagttagggttaaaggggaaaaaaacggttaaagttgggggtacctttagggttaaggtttttaaggttcggggggaaccccgtaaggggggtaaccgtacccccggtttggggttaccccgttaacccccgg

SEQ ID NO: 411647 - DNA, 587 bp, Homo sapiens
  misc_feature: GZ8MTXP02HEVFY.17.28.C06.1.454.CMB.2.raw
  modified_base (375)..(375): a, c, t, g, unknown or other
  modified_base (398)..(398): a, c, t, g, unknown or other
  modified_base (478)..(478): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagctggtcagcgtgggggtcctgagactctcctgtgcagcctccggacttccccttcagttagttattggatgtacttgggtccgcagactccgagggaaggggctggagtggtggccaacagtaaagcaaagataggaactgcccgtagttttacgnggactcgtgtgaggggccgtttnacctatctcagacacaacgaccaaagattcactgtactactaacaactagaacagcctagagtagcgcagacacggcgtnttacttactgtgacgtagtagtagtaaacggtaaaaagtagtacggtacttggttaggttttaacggttcgggggaccgaggggtacgtacccgtgggtacctacccgg

SEQ ID NO: 411648 - DNA, 551 bp, Homo sapiens
  misc_feature: GZ8MTXP02HMAWF.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggagcctggtccagcctgggggtccctgagactctcctgtgcagcctccggattccccttcagtagttattggatgacttggtccgccagactccagggaaggggctggagtgggtgccaacataaagcaagatggaactgcccgtagtttacgtggtactctgtgaggggtcctttcaccatctccagagacaacgccaaagatcactgtatctaacaactgaacagcctgagagtcgacagacacggccgtgtattacgtgtgacgagagtgtaaggaaaaagtagtcggactgtagttaagttggggacaggggactcccgtggtctacccgg

SEQ ID NO: 411649 - DNA, 576 bp, Homo sapiens
  misc_feature: GZ8MTXP02GJ0F3.17.28.C06.1.454.CMB.2.raw
  modified_base (459)..(459): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagcctggtccagcctgggggtccctgagactctcctgtgcagcctccggattccccttcagtagttatggatgacttggtccgccagactccagggaaggggctggagtgggtggccaaacataaaagcaaagatggaaactgccccgagtttacgtggactctgtgaggggcctttcaccatctccagagaacaaacgccaaagaaattcaactgtaatctaacaaactgaaacaagaccngagagtcgacagaacaacgaccgtggtattaatgtggcgagagtagtaaggtaaaaagtaaaagtagtacgtgttgttaagttagggtacggacgggaggaccgtcggtacgtaccg

SEQ ID NO: 411650 - DNA, 579 bp, Homo sapiens
  misc_feature: GZ8MTXP02FPHOL.17.28.C06.1.454.CMB.2.raw
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggagcctggtccagcctgggggtcctgagactctcctgtgcagcctccggattccccttcagtagttattggatgacttgggtccgccagactccgagggaaggggctggagtgggtggccaacataaaagcaagatggaactgccgtagttttacgtggactctgtgaagggtccgttcaccatctccagagacaacgcaaagattcactgtatctaacaactgaaacagcctgagagtcgacagacacggccgtatacttacgtgtgtcgagtataggtaaggaaaaagttagtacggtcgttaggttgttttaaggttgggggaccctagggggacgtccccggttggtaccacccggtttcccg

SEQ ID NO: 411651 - DNA, 588 bp, Homo sapiens
  misc_feature: GZ8MTXP02JXZOI.17.28.C06.1.454.CMB.2.raw
  modified_base (373)..(373): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttgtgagtcggggagctggtccagcctgggggtcctgagactctcctgtgcagcctccggattccccttcagtagttattggatgtacttgggtccgccagacctccgaggggaaggggctggagtgggtggccaacataaagcaaagatggaactgccccgtagtttacgngactcgtgtgagggtcctttcacctatctccagacgacaacgccaaagatcactgtatactacaactagaacagcctagagagtcgacgagaccgacggccgtagtacttacgtgtcgacgagataggaaaggtaaaaagtagttaggacttaggttaggtttaacggttgggggtacccgtagggggtaccgtcccgttacggtccgtacccgg

SEQ ID NO: 411652 - DNA, 704 bp, Homo sapiens
  misc_feature: GZ8MTXP02JZMCA.17.28.C06.1.454.CMB.2.raw
  modified_base (392)..(392): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggttgaggtccggggagctggtccagccgtgggggtccctgagactctcctgtgcagccctccggacttccccttcagttagttattggatgacgttcgggtccgccagactccgaggggaaggggctggaggtggggtggaccaaacgataaaagcaaagataggaactggaccccgtagttttacgnggactcgtgtggacggggtccgtttcacctattcctaccgaagacgaaccgaaaccgaccgaaaacgtaaacgttccaacgttacggttaacttacctaaacaaaccttacggaaaacctaacggtccccgttaagggaacggtaacggtaccggaccgaacggaaccgacccggggtacccgttaggttaacttacgttggtacggcgtaaggtagtagggtaaagggtaaaaaaggttaagtcggtacttaggttaggtttaaggttcgggggaccgtagggggaccgtcccgttcgggtacctacccgg

SEQ ID NO: 411653 - DNA, 677 bp, Homo sapiens
  misc_feature: GZ8MTXP02HUFCL.17.28.C06.1.454.CMB.2.raw
  modified_base (209)..(209): a, c, t, g, unknown or other
  modified_base (237)..(237): a, c, t, g, unknown or other
  modified_base (245)..(245): a, c, t, g, unknown or other
  modified_base (261)..(261): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccgggnagaggtcaccatatcttgtctggaaacngctccggnatctacaactaaactnttttgctgtaccagcaattcccgaggactccggcccccgactcctcatctataagaaatgatcacgtccggccccgtcccggggtcccctagaccccgtactttccgtcctcggtctcccgtagttcgtcctcggcccacccgtcaccgtcccctaccccgtacgacccactccgtacggtcgggcccgttcccgggtccggaaggtacgtggtacggtcgttagttactttatttacgttggtacgtaccggtacccgggtagggtactacggaacctactacccgtaggtaacggttcggggttccgggttcgggttccgggggacgggtacggggtacccgacgggtccgtacggtacccggttaaccgtaacgtaccgaccgacccgtaaacggtcccgtccggtacccccg

SEQ ID NO: 411654 - DNA, 592 bp, Homo sapiens
  misc_feature: GZ8MTXP02JMK5W.17.28.C06.1.454.CMB.2.raw
  modified_base (302)..(302): a, c, t, g, unknown or other
  modified_base (378)..(378): a, c, t, g, unknown or other
  modified_base (455)..(455): a, c, t, g, unknown or other
  modified_base (483)..(483): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggttgagtccgggggagcctggtccagccgtggggggtccctgagactctcctgtgcagcctcggattcccctcagtagttatggatgacttgggtccncagacctccgaagggaaggggctggagtgggtggccaaacataaagcaagatggaactgaccccgtagttttacgnggtactctgtgaggggtcctttcaccatctccagagacaacgaccaagatcatgtatcaacatgaacagcctgacgngtacgcaagacacggcctagtacttacngtacgcgtaagattaggtaaaggaaaaagttagtagggtacttaggttaggtttaaggttcgggggacctaaacgggggactcccccggttagggttacccctacccgg

SEQ ID NO: 411655 - DNA, 572 bp, Homo sapiens
  misc_feature: GZ8MTXP02HO190.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggaggcctggtccagcctgggggtccctgagactctcctgtgcagcctccggattccccttcagtagttattggatgacttgggtccgccagactccgaggggaaggggctggagtgggtggccaacataaagcaagatggaactgccccgtagttttacgtggacttctgttgaggggcctttcaccatctccgagacgacaacgaccaaagaatcaactgtatactacaactagaacagcctgagagtcgcgagacacggccgtagtattactgtagcgagatggtaagaaaagtataggtacttggttagtttaaggtcggggacgtaggggacgtcccgtaggtcctacccgg

SEQ ID NO: 411656 - DNA, 567 bp, Homo sapiens
  misc_feature: GZ8MTXP02HPQON.17.28.C06.1.454.CMB.2.raw
  modified_base (342)..(342): a, c, t, g, unknown or other
  modified_base (378)..(378): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggctggtccagccgtgggggtccctgagactctcctgtgcagcctccggattccccttcagtagttattggatgacttgggtccgccagactccgagggaaggggctggagtgggtggccaanataaagcaaagatggaactgccccgtagttttacgnggactctgtgaggggtcctttcaccatctccagagacaacgccaagaattcactgtatctaacaactgaacagcctgacgtagtcgacagaccacggccgtgtacttacgtgtgcgagagtgtaaggaaaaagtaatgggacttggttagtttaagtgggggaccaggggacgtcccgtgggtactacg

SEQ ID NO: 411657 - DNA, 660 bp, Homo sapiens
  misc_feature: GZ8MTXP02JA9AN.17.28.C06.1.454.CMB.2.raw
  modified_base (225)..(225): a, c, t, g, unknown or other
  modified_base (343)..(343): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggttgagtcggggagctggtcngccgtgggggtccctgagactctcctgtgcagcctccggacttccccttcagtagttattggatgacgttgggtcccgccagctccgaggggaaggggctggaggtgggtggccaaanagtaaagcaaagatggaactgccccgtagttttacgtggactcgtgtagacggggtcctttacaccgatcctaccagacgaccaacgaccaaagaacttcaactagtactactaacaactagaacagacctagacgtagtacgacaacggaaccgacgggtaccgttagtaacgtttacgtaggttcggacgtaaggtagttagggtaaaacgggtaaaaaaaggttaacgttagggggtactttagggtttagttttaaggtttcgggggacccgtaagggggtacgtaccccggttggttacccgttaaccccgg

SEQ ID NO: 411658 - DNA, 565 bp, Homo sapiens
  misc_feature: GZ8MTXP02G2ZTO.17.28.C06.1.454.CMB.2.raw
  modified_base (334)..(334): a, c, t, g, unknown or other
  modified_base (346)..(346): a, c, t, g, unknown or other
  modified_base (370)..(370): a, c, t, g, unknown or other
  modified_base (406)..(406): a, c, t, g, unknown or other
  modified_base (445)..(445): a, c, t, g, unknown or other
  modified_base (458)..(458): a, c, t, g, unknown or other
  modified_base (481)..(481): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtcagttggtgagtcggggagctggtcagcctgggggtccctgagactctcctgtgcagcctccggattccccttcagtagttattggatgacttgggtccgccagactccgaggggaagggctgggagtgggtggccaaanataaagcaaagntaggaactgccgtagtttttacgnggtactcgtggtggacggggtccgtttcacgtatcnccagagacaacgcaaagatcactgtatcaacactgaacngctagagagtcgnagacacgcgtagtattctgtcgngaagtataggtaaggaaaaagtagtggacttaggttagtttaaggtgggggacctaggggacgtcccgtgggtccaccggttcc

SEQ ID NO: 411659 - DNA, 594 bp, Homo sapiens
  misc_feature: GZ8MTXP02FVMEN.17.28.C06.1.454.CMB.2.raw
  modified_base (456)..(456): a, c, t, g, unknown or other
  modified_base (492)..(492): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagccgtgggggtccctgagactctcctgtgcagcctccggacttccccttcagtagttattggatgacttgggtccgccagacctccgaggggaaggggcgtgggaggtggggtggaccaaacataaaagcaagatggaactgccgtagttttacgtggactctgtggaagggtccgttcacatcctccagagacaacgccaaagatcactgtactctaacaactgaaacngacctagagagtcgcagacacggccgtgtattacgngtgcgagagtaggtaaaggaaaaagtagtaggtcttaggttagttttaggtgggggacccgaagggggtaccgtccccgttagggtcccacccggtttcccg

SEQ ID NO: 411660 - DNA, 584 bp, Homo sapiens
  misc_feature: GZ8MTXP02HF620.17.28.C06.1.454.CMB.2.raw
  modified_base (378)..(378): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagccgtgggggtccctgagactctcctgtgcagcctccggattccccttcagtagttattggatgacttgggtccgccagacctccgagggaacggggctggagtgggtgccaacataaagcaaagatggaactgcccgtagtttacgnggactctgtgacggggtcctttcaccatctccagacgacacgaccaaagattcactgtatactaacaactagaacaagcctagacgagtcgacagacgaccggtcgtagtattacgtgtacgacgagataggtaaggtaaaaagtagtacggtactggttagtttaagttggggaccgtaggggacgcccggtacgtccgtacccg

SEQ ID NO: 411661 - DNA, 603 bp, Homo sapiens
  misc_feature: GZ8MTXP02HWHDE.17.28.C06.1.454.CMB.2.raw
  modified_base (208)..(208): a, c, t, g, unknown or other
  modified_base (392)..(392): a, c, t, g, unknown or other
  modified_base (401)..(401): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtctcgggacccccggnagaggtcaccatatcttgttctggaaacagctccggcatctacaactaaactattttgctggtaccagactaattccccaaggactccggccccccactcctcatctaataagaaatgatcaatccggcccctccggggtccctgaccccgtattcctctcggcttccatcgtctgccaccctnacgcctccncacatcacgtcggcgtcgtccgagagtagagcgtatattattaacttgttgacgaccgttaggtagtaggaactactaccgtacgtaagtacggttccgggttcgggttcggggtacgggacggggaaccggacggaccgtacggtaccgtaaccgttaacgtacgtaccgacccgtaccggtaaccgaccgttccccccgg

SEQ ID NO: 411662 - DNA, 614 bp, Homo sapiens
  misc_feature: GZ8MTXP02HBU1U.17.28.C06.1.454.CMB.2.raw
  modified_base (206)..(206): a, c, t, g, unknown or other
  modified_base (236)..(236): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggnagagggtcaccatatcttgttctggaaacngctccggcatctacaactaaactattttgctggtaccagcaacttcccaggactccggccccccgactcctcatctaatagaaatgatcatccggccccgtccggggtcctcggaccgtacttcctcgtcggcctcattcgtccgtggccacccgtcaccgtccctccctacgacccagtccgaggtcgggcctcccgggtaccgaggactggacggtctagtaatttacgttacgtcgttcgaccgtacgggtagggtactgactacttccgtagtaaggtcgggttccggttacggtcgggacgggtaacgggaccacgggctcggacccgttacgtaacggtcgacgacccggagccgtcccggccccgtaccgg

SEQ ID NO: 411663 - DNA, 635 bp, Homo sapiens
  misc_feature: GZ8MTXP02HZQ0C.17.28.C06.1.454.CMB.2.raw
  modified_base (346)..(346): a, c, t, g, unknown or other
  modified_base (391)..(391): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtgggggtccctgagactctcctgtgcagccctccggacttccccttcagttagttattggatgtacgttgggtccgccagactccgaggggaaggggctggaggtggggnggaccaaacataaagcaagataggaactgacccgtagttttacgngactgtgtgagggtccttcaccatcctcagagacaacgacaaagaattcaacttagtactactaacaaactagaaacagtcctagagagtcgacgacgaccgaccggaccggttagtaacgttacgtgtagacgaagtagttagggtaaaggtaaaaaaggttagtagggtacttaggtttaggtttaaggtttacgggggaccgtacgggggtaccgtaccccggttaggtacccgtacccgg

SEQ ID NO: 411664 - DNA, 712 bp, Homo sapiens
  misc_feature: GZ8MTXP02IXK8R.17.28.C06.1.454.CMB.2.raw
  modified_base (237)..(237): a, c, t, g, unknown or other
  modified_base (260)..(260): a, c, t, g, unknown or other
  modified_base (400)..(400): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcggggacccccggcagagggtcaccatatcttgttctggaaacngctccggcatctcaactaaactnttttgctggtaccagcaactcccaggactcccggccccccgtactcctcactctataagaaatgactcacgtccggccccgtccggggtccctggaccgatttcctcgtcggtcctccagttcgtcgtcggccacccgtnaccgccctacccgtcgaaccctattcccgagggttcgggcccgttacccggggtacccgaggggtacgttacggacgggtcctaggtaaacttttacgtttaacgtcgggttacgtaccgtacccggggttaggggacttagggaacctacttcccggtaggtaacggtttcggggttacccgggtttcgggttcccgggggacgggggtaacggggtaccggaacgggtcccgtacggtaaccccgttaaccgttaacggaccggaccggtaccccgaaggtcccccgttaccggaccccccgtttcgggg

SEQ ID NO: 411665 - DNA, 549 bp, Homo sapiens
  misc_feature: GZ8MTXP02FHX20.17.28.C06.1.454.CMB.2.raw
  modified_base (236)..(236): a, c, t, g, unknown or other
  modified_base (250)..(250): a, c, t, g, unknown or other
  modified_base (361)..(361): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacngctccggcatcctnaactaaacattttgctggtaccagcaaattccccaggactccggccccccgatccctcatctatagaaaatgatcatccgggccctccggggtccctgaccgactttctcnggcctccatgtctggccacctcacgcctccctgacccatcagtggcgtcccggtcccgaggatgaggctgtattattactgtgcaccggtggatgacatcctgaagtggtccggttcggttcgggcggtacgggaccgacggcgtcgaccgtcctaaacgtcaacgcccaaggctcgcccccgtccgg

SEQ ID NO: 411666 - DNA, 608 bp, Homo sapiens
  misc_feature: GZ8MTXP02JBXRN.17.28.C06.1.454.CMB.2.raw
  modified_base (372)..(372): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctggggggtccctgagactcccctgtgcagcctccggattccccttcagtagttattggatgacttgggtccgccagactccgagggaaggggctgggagtgggtggccaacataaagcaagatggaactgcgtagtttaccgnggactctggtgaagggtccctttcaccatcctaccagacgacaacgaccaaagaacttcaactgtatacctacaactagaacagcctagagagtcgcagacacgccgtagtacttacgtgtcgacgagtagtaggtaagggaaaaagtagtagggtcgttagttacggtttaaggttcgggggaacccgtaagggggacgtcccccggttaggggtccctaacccggttcctcccg

SEQ ID NO: 411667 - DNA, 571 bp, Homo sapiens
  misc_feature: GZ8MTXP02JP6LP.17.28.C06.1.454.CMB.2.raw
  modified_base (344)..(344): a, c, t, g, unknown or other
  modified_base (561)..(571): a, c, t, g, unknown or other
tcagcgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgatcctcatctatagaaatgatcatcggccctccgggtcctgaccgattctctggctccatgtctggcacctcacgcctcccctgaccatcagtcggctccggtcgaggatgaggctgattattacngtgcacgtgggatgacatccgtagaacgttgggtccgggtggtttcgggacgggacggggacccgagggcctcggacccgttacctaaacggtccaacggaccccgaaacggccgtccggtccccccgtcgggtcctaccttcctccgttcccccaccctccctcctacgtcctaccgcgtcgacggcgggtctcgggcaacggccgacacgtacgnnnnnnnnnnn

SEQ ID NO: 411668 - DNA, 567 bp, Homo sapiens
  misc_feature: GZ8MTXP02IACA2.17.28.C06.1.454.CMB.2.raw
  modified_base (265)..(265): a, c, t, g, unknown or other
tcagcgtagactagcacgaccggtgctcgatttagagctcacgtattgggtttggggcagcttcagctgtggtagagaagacaggattcaggacaatctccagcatggccggcttcccctctcctcctcacccctcctcactcactgtgcagggtcctgggcccagtctgtgctgactcagccaccctcagtgtcgtcgggacccccggcagagggtcaccatatcttgttctaggaaacagctccggcatctacaactaaactnttttgctggtaccagcaactccaggactcccggcccccatcctcatctaatagaaaatgatcacgtccggccccgtccggggtccctgaccccgtattcctctcggctccatcgtctaggcctaccctcacgccctccctacgaccatcgagtcggcctccggtcgagactgagctagtattacttacgtgcgtcgacggtggatgactatccgtagtaacgtcggtcggtggttccgggcggacgggaccacggtcgtacgaccgtaacgtacgcgacgacccgacggcctaccgcccccg

SEQ ID NO: 411669 - DNA, 634 bp, Homo sapiens
  misc_feature: GZ8MTXP02IIOR8.17.28.C06.1.454.CMB.2.raw
  modified_base (386)..(386): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggttgagtccggggaggcctggtccagccgtgggggtccctgagactctcctgtgcagcctccggacttccccttcagtagttattggatgacttgggtccgccagactccgaggggaaggggctggaggtgggtggaccaaacgataaagcaaagataggaactgaccccgtagttttacgnggtactcgtggtgacggggtcctttacaccatcctcagacgacaacgccaagatcactagtactctaacaactacgaacacgcctaggacgagtcgacgaagaccgacggtccgttagtaacttacgtggtgacgaggagttaggtaaaaggtaaaaaggttaagtacgggtactttaggtttaggtttaaggtttacgggggacccgtagggggtaccgtcccggttacgggttacccgtaccccgg

SEQ ID NO: 411670 - DNA, 609 bp, Homo sapiens
  misc_feature: GZ8MTXP02GD206.17.28.C06.1.454.CMB.2.raw
  modified_base (302)..(302): a, c, t, g, unknown or other
  modified_base (378)..(378): a, c, t, g, unknown or other
  modified_base (450)..(450): a, c, t, g, unknown or other
  modified_base (494)..(494): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagccgtggggggtccctgagactctcctgtgcagcctccggattccccttcagtagttattggatgacttgggtccnccagactccgaggggaaggggctggaggtggggtggaccaacataaaagcaagatggaactgaccgtagtttacgnggactctgtggaagggtccgtttcacctatcctccagacgacaacgcaaagattcactgtactctacaactnaacagacctgagagtcgcagaccgacggccgtagttacttacgngtgcgagtagtaggtaaaggtaaaaagttaaggtggtacgttaggtttaggttttaaggttcgggggaccgaacgggggtacgtccccggttacggtacccgtacccggtttccc

SEQ ID NO: 411671 - DNA, 695 bp, Homo sapiens
  misc_feature: GZ8MTXP02G1CA3.17.28.C06.1.454.CMB.2.raw
  modified_base (394)..(394): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgttttagaaggtgtccagtgtgagtcagttggtgaggtccggggagctggtccagccgtgggggtcctgagctctcctgtgcacgcctccggacttcccctcagtagttatggatgtacgttcggtccgccagacctccggaggggaaggggctagggaggtggggtcgaccaaacgaagtaaagcaaaggataggaactggaccccgttagttttacgnggtacttcgtggtaggacggggttcctttacgacctagttcctacgaagacgtaaaccaaccgaaccgaaaagtacttacaccgttagttaactaccgttaaacaaaccgtacgaaaaccgtacgtacccgttaagggaacggtacgtacccggacgtaaaccggaccgtaacgggtcccgttagttaaccttagtggtacgcggtaagtagtaggtaaaaggtaaaagttgtcgggtacttggttaggttaacggtcggggaccgtaacggggtccgcccggttcggaccctttacccgg

SEQ ID NO: 411672 - DNA, 628 bp, Homo sapiens
  misc_feature: GZ8MTXP02GGVKD.17.28.C06.1.454.CMB.2.raw
  modified_base (298)..(298): a, c, t, g, unknown or other
  modified_base (372)..(372): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtcagtgtgaggtccagttggttgagtcggggagcctggtccagcctgggggtcctgagactctcctgtgcagcctccggattcccctcagtagttatggatgacttgggtccncagactccgagggaggggctggagtgggtggacaacataaagcaaagataggaactgaccccgtagttttacgnggtactcgtgtaggacgggtcctttcacctatcctaccagacgacaacgaccaagaacttcactgtactctaacaactagaaacagacctagagacgtcgacgaacgaccgacggtaccgttgttaactttacgtggttacgacggtaagtagttagggtaaacgggtaaaaaaggtacgttagggtacttaggtttaggttttaaggttcgggggaccgtacgggggtaccgtccggttcggtaccgttacccgg

SEQ ID NO: 411673 - DNA, 584 bp, Homo sapiens
  misc_feature: GZ8MTXP02F9DL8.17.28.C06.1.454.CMB.2.raw
  modified_base (366)..(366): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgttgctgttttagaggtgtcagtgtgaggtcagttggtgagtcggggagctggtcagccgtgggggtcctgagactctctgtgcagcctcgattccccttcagtagttatggatgacttggtccgcagactccgagggaggggctggagtggggtgccaacagtaaaagcaaagataggaaactgccccgtagttttacgnggactctgtagacgggtcgtttcacatctaccagagaacaacgaccaaagaaattcaactagtatactaacaactagaacaggcctggaacgagtcgacagaacgaccggtccgttagtacttaactggtagcgtaagagttaggtaaaggaaaaagttaagtcggacttggttagtttaaggttggggaccgagggacgtaccgtcggtactacccg

SEQ ID NO: 411674 - DNA, 587 bp, Homo sapiens
  misc_feature: GZ8MTXP02J24RV.17.28.C06.1.454.CMB.2.raw
  modified_base (381)..(381): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggtgagtccgggggagcctggtccagcctgggggtccctgagactctcctgtgcagcctcccggattccccttcagttagttattggatgacttgggtccgccagactccgaggggaaggggctggagtgggtggaccaacataaagcaaagataggaactgccccgtagttttacgnggactcgtgtgacggggccgtttcaccatcctccagacgacaacgccaaagaattcactgtatctacaactgaacagcctagagagtcgacagacgacgggtccgtagtacttacgtgtacgcgaggatggtaaggaaaaagttagtcgggtctggttaggtttaagttcgggggaccagggggtactcccgtagggtccacccgg

SEQ ID NO: 411675 - DNA, 698 bp, Homo sapiens
  misc_feature: GZ8MTXP02GIJ15.17.28.C06.1.454.CMB.2.raw
  modified_base (276)..(276): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgcttgttttagaaggtgtccagtgtgaggtcagttggttgaggtcggggagctggtccagccgtgggggtcctgagctctcctgtgcagcctccggacttccccttnagtagttattggatgtacgttgggtcccgcagaactccgaggggaaggggctgggaggtggggtcggaccaaaacgaataaaacggacgtaaagtagtacggtaacgtcggtacccggttttaggtttacggtcggtaccttcggtaggtaacgggtaccggggtttccttaccacgtactcctacgagaaacaccgaaccgaacgtaaagtaactactaacgttatacctaactaaacctacgaacaacgaccgtcgtaaaggacgtacgggccgacgaccggaccgtaccggtgtttagtaaccgttgtcggtaggagtaagtagtaaagggaaaaagttaaacgtacgtcggtagttaggttttaggttaacggggtcggggtacggtacggggtccgtccgttacgggacccttcccg

SEQ ID NO: 411676 - DNA, 666 bp, Homo sapiens
  misc_feature: GZ8MTXP02H8HL6.17.28.C06.1.454.CMB.2.raw
  modified_base (348)..(348): a, c, t, g, unknown or other
  modified_base (397)..(397): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtcagtgtgaggtcagttggttgaggtcggggagctggtcagcgtgggggtcctgagactctcctgtgcagcctccggtacttcccctcagtagttattggatgtacgttgggtccgccagaccgtccgaggggaaggggctgggaggtggggtcggaccaaanaagtaaaaggacaaaggagtacggaactcggaccccgttagttttacgnggtacttcgtggttaggacgggtccgtttacacctatcctcaagacgaacaacgacctaaagtaacttcacgttagtaactacctaacaaactacgaaacacgaccgtagaaggacgtacgacgaacgacgaccgggtaccgtagttacgttacgtgtacgacgaggtagttaggtaaaaggtaaaaacgttaggtggtacgtttggtttaggttttaacggtacgggggacccgtaggggaccgtcccggttcgggtaccctacccgg

SEQ ID NO: 411677 - DNA, 633 bp, Homo sapiens
  misc_feature: GZ8MTXP02IX44M.17.28.C06.1.454.CMB.2.raw
  modified_base (376)..(376): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggtgagtccggggagctggtccagcctgggggtccctgagactctcctgtgcagcctccggacttccccttcagttagttattggatgacttgggtccgcagactccgaggggaaggggctggagtggggtgaccaaacataaagcaaagatggaactgcccgtagtttacgngactctgtgaggggtcctttcaccatcctaccgagacacaacgccaaagtaattcactgtactactaacaactagaacacgcctagagtagtcgacgaacgaaccgaccgggtaccgttaggttactttaacgtgggtgaccggtaagtaagttagggtaaacgggtaaaaaaagttagttcgggtacgtttaggtttaggttttaaggttgggggtaccggaagggggtacgtccccggttggtacccgtaccccg

SEQ ID NO: 411678 - DNA, 501 bp, Homo sapiens
  misc_feature: GZ8MTXP02I7CNB.17.28.C06.1.454.CMB.2.raw
  modified_base (359)..(359): a, c, t, g, unknown or other
  modified_base (392)..(392): a, c, t, g, unknown or other
  modified_base (474)..(474): a, c, t, g, unknown or other
  modified_base (491)..(501): a, c, t, g, unknown or other
tcagcgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatccggccccccgactcctcatctatagaaatgatcatcggccctccgggtccctgaccgattctctggctccatgtctggcacctcacgcctccctgaccatcagtggctccggtccgaggatgagctgattatctgtgcacgtggatgacntcctgaatggtccgtgtcggcggagggcaggcngacccgtctaagtcacgcccaaggctcgccccctcggtcactctcgttccccaccctcctcctatctacgctgacgcggtcnggcaaggcgcacgtagnnnnnnnnnnn

SEQ ID NO: 411679 - DNA, 560 bp, Homo sapiens
  misc_feature: GZ8MTXP02IAD3B.17.28.C06.1.454.CMB.2.raw
  modified_base (378)..(378): a, c, t, g, unknown or other
  modified_base (415)..(415): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagccgtggggggtccctgagactctcctgtgcagcctccggacttccccttcagttagttattgggatgacttgggtccgccagactccgagggaaggggctggagtggggtggccaaacataaaagcaagatggaactgccgagttttacgnggactctgtgaagggtccgtttcactatcctccaganacaacgcaagaatcactgtatctaacaactgaacagcctgagagtcgcagacacggccgtgtatactgtgtcgagtataggtaggaaaaacgtagtggctggttgtttacgtgggggccaaggggctcccgtggtcctaccgtcc

SEQ ID NO: 411680 - DNA, 613 bp, Homo sapiens
  misc_feature: GZ8MTXP02JVP01.17.28.C06.1.454.CMB.2.raw
  modified_base (305)..(305): a, c, t, g, unknown or other
  modified_base (377)..(377): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggagcctggtccagccgtgggggtccctgagactctcctgtgcagcctccggattcccctcagtagttattggatgacttgggtccncagactccgagggaggggctggagtgggtgaccaacataaagcaaagatggaactgccccgtagttttacgnggtactcgtggtagacggggtccctttacacctatcctccgagaacgaacaaccgaccaaagaattcactgtatctaacaactagaactagcctagacgagtcgacaagtaccgacggccgttgtaacttacgtgtgacgagagtaggtaaaggtaaaaagtagtaggtacgtggtttagtttaacggttcgggggaccgagggggtaccgtcccggtacgggttcctaaccccgg

SEQ ID NO: 411681 - DNA, 589 bp, Homo sapiens
  misc_feature: GZ8MTXP02HHXJ2.17.28.C06.1.454.CMB.2.raw
  modified_base (269)..(269): a, c, t, g, unknown or other
  modified_base (277)..(277): a, c, t, g, unknown or other
  modified_base (295)..(295): a, c, t, g, unknown or other
  modified_base (372)..(372): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaagtgtcagtgtgagtcagtggttgagtcggggagcctggtccagccgtgggggtcctgagactctctgtgcagcctccggattcccctnagtagttnttggatgacgttggtccncagactccgaggggaagggctggaggtgggtcggaccaaacagtaaagcaaagatggaactgacccgtagtttacgnggactctgtgagggtccttacaccatcctacagacgaacaacgccaaagaattcaacttgtatactaacaactacgaacagtcctagacgagtcgacagaccgacggccgttagtaattacgtgtacgacggtaagtagtaggtaaaggtaaaaagtacgtggacttggttagtttaaggtcggggaccgaggggtcgtcccgtacggtcctacccg

SEQ ID NO: 411682 - DNA, 583 bp, Homo sapiens
  misc_feature: GZ8MTXP02IZRAZ.17.28.C06.1.454.CMB.2.raw
  modified_base (374)..(374): a, c, t, g, unknown or other
  modified_base (460)..(460): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggagcctggtccagcctgggggtccctgagactctcctgtgcagcctccggattccccttcagtagttattggatgacttgggtccgccagactccgagggaaggggctggagtgggtggccaacataaagcaagatggaactgccccgtagtttacgngactctgtagaggggtcctttcacctatcctccagacacaacgccaaagaattcaactgtactctaacaactgaacagcctagagngtcgcagacgacggccgtgtacttactgtgcgaagattaggtaaggaaaaagttagtaggtacttggttagttttaaggttcgggggaccgagggggtacgtccccgttgggtacctacccgg

SEQ ID NO: 411683 - DNA, 591 bp, Homo sapiens
  misc_feature: GZ8MTXP02JKTIC.17.28.C06.1.454.CMB.2.raw
  modified_base (379)..(379): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagccgtgggggtccctgagactctcctgtgcagcctccggattccccttcagtagttattggatgacgttgggtccgccagactccgagggaaggggctggaggtgggtggccaaacataaagcaagatggaactgcccgtagtttacgngactctgtgagggtccgttcacgatctccagagacaacgaccaaagatcactagtactactaacaactagaacacgccgtagagacgtcgacgagacgaccggccgtagttattacgtgtgacggagagtggtaaaggaaaagttagtcggtacttaggttacgtttaaggttcgggggaccgagggggacgtcccgtggtacccgtacccg

SEQ ID NO: 411684 - DNA, 584 bp, Homo sapiens
  misc_feature: GZ8MTXP02HQDHR.17.28.C06.1.454.CMB.2.raw
  modified_base (383)..(383): a, c, t, g, unknown or other
  modified_base (389)..(389): a, c, t, g, unknown or other
  modified_base (411)..(411): a, c, t, g, unknown or other
  modified_base (489)..(489): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtggggggtccctgagactctcctgtgcagcctccggattccccttcagtagttattggatgacgttgggtccgccagacctccgaggggaaggggctgggagtggggtggccaacataaagcaagatggaactgcccgtagtttacgngactcngtgagggtcctttcaccatccncagagacaacgaccaagtatcactgtatactacaactagaacagcctagagagtcgcagacacggccgtgtattacgngtgacgagagtggtaaaggaaaaagttacgtaggcgttaggttagtttaacggttacgggggccgtaggggacgtcccggttggtcccgtacccg

SEQ ID NO: 411685 - DNA, 598 bp, Homo sapiens
  misc_feature: GZ8MTXP02JSNHY.17.28.C06.1.454.CMB.2.raw
  modified_base (237)..(237): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggcagagggtcaccatatcttgttctggaaacngctccggcatctacaactaaactattttgctggtaccagctaattcccaggactccggccccccgatccctcatctatagaaatgatcacgtccggccctccggggtccctgaccgacttcctctggcctccatgtctcggcaccgtccagccctcctgacccatcgagtcgggcctcgggtccgaggactggacggctgtattattacgtgtcgcgtaccggtgggactggactactccgtagtacgttggggtcccggttggttccgggcggggacgggaccgaacgggcctacgggaccccgttaccgtaacgtccaaccggaccccgtaaagggtcccctccggtcccccgttccgg

SEQ ID NO: 411686 - DNA, 703 bp, Homo sapiens
  misc_feature: GZ8MTXP02JD0UJ.17.28.C06.1.454.CMB.2.raw
  modified_base (279)..(279): a, c, t, g, unknown or other
  modified_base (399)..(399): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggttttcctgttgctgttttagaggtgtccagtgtgaggtccagttggttgagtccggggagcctggtccagccgtgggggtccctgagactcgtcctgtgcacgcctccggtacttccccgtnagtacgttagttggatgacgttcggtccgactagaccgtcgaggggaacgggtctggagtggggcgaccaaacgagtaaaacgcaaaggatacggaaactcgtacccgtagttttaccgngtacgttcgtagtacgggacggggttcccgttacgaccgtaactccgtaccgtaaagacgtaaacccgaaccgtacccgaaaggtaaccttcgtaaacgttgttaactaccgtaaacaaacgtacgaaaccgtagtccccgtaggaaggtacgttaccggacgtaacggaaccgtaccgggtacccttaggttactacgtggacgtacgaagtagtacggtaaaggtaaaacgttacgtcggtacgttagttaggttaacggtcggggacctaggggaccctccggttacggacttaaccccgg

SEQ ID NO: 411687 - DNA, 641 bp, Homo sapiens
  misc_feature: GZ8MTXP02JBK8T.17.28.C06.1.454.CMB.2.raw
  modified_base (384)..(384): a, c, t, g, unknown or other
tcagcgtagactagcacgaccggtgctcgatttagagctcacgtattgggtttggggaggtctcagagaggaggcttagccctggacaccaaggcctttccacttggtgatcagcactgagcacagaggactcaccatggagttggggctgaactgggttttccttgttgctgttttagaaggtgtacagtgtgaggtccagttggttgaggtccgggggagcctggtccagccgtggggggtccctgagactctcctgtgcagccctccggacttccccttcagtagttattggatgacttgggccgccagactccgaggggaaggggctggagtggggtggccaaacataaagcaaagatggaaactgcccgtagtttacgngactcgtgtgacgggtcctttcacctatcctccagagaaccaacgacccaaagaattcactgtactctaacaactagaaactacgaccgtagaacggtagtacggacaaggaaccgaccgggtacccggttaggttacttaacgtgtcgacgacgtagtaggtaaacgggtaaaaaagttacgtaggtacgttaggttaggttttaaggtcgggggtacccgtaggggtacgtcccggtacgggtaccgtaacccgg

SEQ ID NO: 411688 - DNA, 579 bp, Homo sapiens
  misc_feature: GZ8MTXP02GJFSB.17.28.C06.1.454.CMB.2.raw
  modified_base (374)..(374): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattccccttcagtagttattggatgacttgggtccgccagactccgaggggaaggggctgggaggtggggtggccaacataaagcaagatggaactgccgtagttttacgnggtactctggtggaagggtccgtttacaccatctaccagacgacacgacaagatcactgtatctacaactgaacagacctagagagtcgacacgacgaccggccgtagtacttacgtggtgacgagtacgtggtaaaggaaaaagtagtggactggttagtttaggtgggggccgaggggacgcccgtggtcccgtacggttccc

SEQ ID NO: 411689 - DNA, 516 bp, Homo sapiens
  misc_feature: GZ8MTXP02I3PV1.17.28.C06.1.454.CMB.2.raw
  modified_base (347)..(347): a, c, t, g, unknown or other
  modified_base (350)..(350): a, c, t, g, unknown or other
  modified_base (363)..(363): a, c, t, g, unknown or other
  modified_base (367)..(367): a, c, t, g, unknown or other
  modified_base (506)..(516): a, c, t, g, unknown or other
tcagcgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatccggccccccatcctcatctatagaatgatcatcggccctccgggtccctgaccgattctctggctccatgtctggcacctcacgccctcccctgaccatcagtcgggctccggtccgaggatgaggctgattattacngtncacgtggatgacntccngaatggtccggtgtcgggcggagggacaggctagaccgtctaagtcacgcccgaaggcctcgccccctcggtctactctccgtcccaccctcctcctagtctacgctgacgcgggctgggacaacgggcgacacgtagnnnnnnnnnnn

SEQ ID NO: 411690 - DNA, 546 bp, Homo sapiens
  misc_feature: GZ8MTXP02HU4JH.17.28.C06.1.454.CMB.2.raw
  modified_base (380)..(380): a, c, t, g, unknown or other
  modified_base (485)..(485): a, c, t, g, unknown or other
  modified_base (509)..(509): a, c, t, g, unknown or other
  modified_base (533)..(533): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctgggggtccctgagactctcctgtgcagccctccggattccccttcagtagttattggatgacttgggtccgccagactccgaggggaaggggctggagtgggtggccaaacataaagcaaagatggaactgccccgagttttacgngactctgtgagggccgtttcaccatctccagacgacaaacgccaaagaattcacttgtatctaacaactgaacagcctgagagtcgcagacacggcgtgtatacngtgcgagatggtaagaaaagtacnggactgtgttaagtgggcagggcnccgtggtctaccg

SEQ ID NO: 411691 - DNA, 601 bp, Homo sapiens
  misc_feature: GZ8MTXP02H79G0.17.28.C06.1.454.CMB.2.raw
  modified_base (387)..(387): a, c, t, g, unknown or other
  modified_base (485)..(485): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtggggggtccctgagactctcctgtgcagccctccggtacttccccttcagtagttattggatgactgggtccgccagacctccgaggggaaggggctggaggtggggtggaccaacaataaagcaaagatggaactgccgagttttacgnggactctgtgagggtccgtttcacctatcctccagacgaccaacgccaaagaacttcaacttgtatactaacaactgaaacagcctagagtagtcganacgacacggccgtagtacttacgtgtgacgagagtaggtaaggaaaaagtagtaggtacgttggttaggtttaaggtcgggggaccgtaaggggcgtcccgtaggtacctacccgg

SEQ ID NO: 411692 - DNA, 565 bp, Homo sapiens
  misc_feature: GZ8MTXP02JERF3.17.28.C06.1.454.CMB.2.raw
  modified_base (260)..(260): a, c, t, g, unknown or other
  modified_base (302)..(302): a, c, t, g, unknown or other
  modified_base (328)..(328): a, c, t, g, unknown or other
  modified_base (344)..(344): a, c, t, g, unknown or other
  modified_base (369)..(369): a, c, t, g, unknown or other
  modified_base (378)..(378): a, c, t, g, unknown or other
  modified_base (438)..(438): a, c, t, g, unknown or other
  modified_base (497)..(497): a, c, t, g, unknown or other
  modified_base (502)..(502): a, c, t, g, unknown or other
tcagcgtagactagcacgaccggtgctcgatttagagctcacgtattggggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccaggcctgggggtccctgagactctcctgtncagcctccggattcccctcagtagtattggatgactggtccncagactccagggagggctggagtggngccaacataagcaagntggaactggccccgtagtttaccgnggactctgngacggggtcctttcacgtatctcagcacacgctaaagactcactagtattacaactaacngaaacagtaccctaggagttagcgcaacgaccgtacggcccgttaggtacttactggtnacganagtgtaaagggaaaaatcgtgacgtgttagttaagttgggccgagggcgtccgtggtctcccg

SEQ ID NO: 411693 - DNA, 588 bp, Homo sapiens
  misc_feature: GZ8MTXP02FQ73W.17.28.C06.1.454.CMB.2.raw
  modified_base (358)..(358): a, c, t, g, unknown or other
  modified_base (380)..(380): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagccgtgggggtccctgagactctcctgtgcagcctccggacttccccttcagtagttatggatgacttgggtccgccagactccgagggaaggggctggaggtgggtggaccaacataaagcaaaganaggaactgcccgtagtttacgngactctgtagagggtccgttcaccatctcagagacaacgaccaagaactcactagtacttctaacaactagaacagccagagagtcgacagaccacgggcctagttatacgtgtgacgagataggtaaggaaaaagtagtacggtcgttaggttaggtttaacggttcgggggaccagggggaccgtcccgtcgggtacctaccccgg

SEQ ID NO: 411694 - DNA, 658 bp, Homo sapiens
  misc_feature: GZ8MTXP02GX9ZI.17.28.C06.1.454.CMB.2.raw
  modified_base (208)..(208): a, c, t, g, unknown or other
  modified_base (238)..(238): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccggnagaggtcaccatatcttgttctaggaaacngctccggcatctacaaactaaactattttgctggtaccagctaacttcccgaggactccccggccccccgactcctcactactaataagaaatgactcacgtcccggtccccgtccggggtccctgaccccgtacttctctcggcctccattcgtctcggcctaccctccgacgtcccctacccgtacgaccctacgtcgacgggtcgggtacccgttcccgggtccggaggtagtcggacggtcttagtatttacgttacgttggtacgaccgtaccggtgggactacggaactacgttccgtaggtacggttccggggttccgggttacgggtaccggggaccgggtacggggaccgtacgggtccgtacggtacccgtcgtaacgtcgaccgacccgacgtcccgtcccgtcccccg

SEQ ID NO: 411695 - DNA, 508 bp, Homo sapiens
  misc_feature: GZ8MTXP02JBRHU.17.28.C06.1.454.CMB.2.raw
  modified_base (365)..(365): a, c, t, g, unknown or other
  modified_base (499)..(508): a, c, t, g, unknown or other
tcagcgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggactccggcccccccgactcctcatctatagaaatgatcatccggccctccgggtcctgaccgattctctggctccatgtctggcacctcacgcctcccctgaccatcagtggctccggtccgaggatgaggctgattatactgtcgcacgtggatgacntcctgatggtcgtgtcgggcggaggcaggctgaccgtctacgtcacgccgaagcctcgcccccgtcgcactcctcgtccccacctcctccgtatcctacgctggacgcggtctggactaacgggcaccagtgcnnnnnnnnnn

SEQ ID NO: 411696 - DNA, 575 bp, Homo sapiens
  misc_feature: GZ8MTXP02JUJD2.17.28.C06.1.454.CMB.2.raw
  modified_base (379)..(379): a, c, t, g, unknown or other
  modified_base (426)..(426): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctgggggtccctgagactctcctgtgcagcctccggattccccttcagtagttattggatgacttgggtcccgcagactccgagggagggctggagtgggtggcaacataaagcaagatggaactgccccgtagtttacgtggactntgtgagggtccttcaccatcctcagagacaacgcaaagatcatgtanctacaactgaacagcctgagagtcgacagacgacggccgtagtattactgtagcgtaagagtaggtaaaggtaaaaagttagtacgggctttaggttaggtttaagttcgggggaccgtaggggacgtcccgtcgggtacctaccccgg

SEQ ID NO: 411697 - DNA, 596 bp, Homo sapiens
  misc_feature: GZ8MTXP02HELXK.17.28.C06.1.454.CMB.2.raw
  modified_base (338)..(338): a, c, t, g, unknown or other
  modified_base (373)..(373): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggttgagtccggggagcctggtccagccgtgggggtccctgagactctcctgtgcagcctccggattcccctcagtagttattggatgacttgggtccgccagactccgagggaaggggctggagtggtgccaanagtaaagcaagatggaactgccccgtagtttacgnggactctgtgagggccgtttcacctatctcagacgacaacgccaagaattcaactgtatctacaactgaacagcctgagagtcgacagacacggccgtgtaacttacgtgtcgcgtaagacgttaggtaacggtaaaaagttactagggtacttaggtttaggtttaaggtttcgggggacccgtagggggtaaccgtccccggttaggtaccctaaccccgg

SEQ ID NO: 411698 - DNA, 574 bp, Homo sapiens
  misc_feature: GZ8MTXP02HDQ0L.17.28.C06.1.454.CMB.2.raw
  modified_base (280)..(280): a, c, t, g, unknown or other
  modified_base (377)..(377): a, c, t, g, unknown or other
  modified_base (385)..(385): a, c, t, g, unknown or other
  modified_base (404)..(404): a, c, t, g, unknown or other
  modified_base (408)..(408): a, c, t, g, unknown or other
tcagcgtagactagcacgaccggtgctcgatttagagctcacgtattgggtttggggaggtctcagagagaaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtggggggtccctgagactctcctgtgcagcctccggattcccctnagtagttattggatgacgttggtccgccagacctccgagggaggggctggagtgggtggcaacataaagcaagatggaactgccccgtagtttacgngactctgngacgggccttacaccatcncganacgacacgaccaagaattcactgtatactaacaactagaacagccctaggagacgtcgcaagaccgacggccgtagtattaccgtgtgacgagagtaggtaaaggaaaagtagtcggactggttagtttaacggtgggaccgagggacgcccgtacggcctaccgg

SEQ ID NO: 411699 - DNA, 625 bp, Homo sapiens
  misc_feature: GZ8MTXP02ISMJG.17.28.C06.1.454.CMB.2.raw
  modified_base (274)..(274): a, c, t, g, unknown or other
  modified_base (299)..(299): a, c, t, g, unknown or other
  modified_base (376)..(376): a, c, t, g, unknown or other
  modified_base (522)..(522): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaggtgtccagtgtgaggtccagttggttgaggtcggggagcctggtccagccgtgggggtccctgagactctcctgtgcagcctccggacttccccttnagttagttatggatgacttggtccnccagactccgaggggagggctggaggtgggtgaccaacaagtaaagcaaagagtaggaactggccgtagttttacgnggtactcgtgtggaacgggtccgtttacacctatcctaccagacgacaaccgacaaagtactcacttgtaactctaacaactagaaacacgacctaggagacgtcgacgaacggaaccgacgggtccgttagtaacttacgttggngacgaagtagtaggtaaaggtaaaaacgtagtaggtacgttaggtttagtttaggttcgggggacgacgggggttaccgcccgttgggtaccctacggttccc

SEQ ID NO: 411700 - DNA, 592 bp, Homo sapiens
  misc_feature: GZ8MTXP02FYTAG.17.28.C06.1.454.CMB.2.raw
  modified_base (298)..(298): a, c, t, g, unknown or other
  modified_base (371)..(371): a, c, t, g, unknown or other
  modified_base (487)..(487): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagctggtcagcctgggggtccctgagactctcctgtgcagcctccggattccccttcagtagttatggatgacttgggtccncagactccgagggaggggctggagtgggtggccaacataaagcaaagataggaactggccccgtagtttacgngactctgtgagggtcctttcacctatcctacgagacgacaacgccaaagtaacttcaactgtactctaacactagaacagcctgagagtcgacacgacgacggccgtgtattacgngtgacgagtagttagggtaaggtaaaaagttagtagggtacgttggtttaggtttaaggttcgggggaccgtagggggaccgtcccggtcggtacccgtacccgg

SEQ ID NO: 411701 - DNA, 560 bp, Homo sapiens
  misc_feature: GZ8MTXP02IF8N7.17.28.C06.1.454.CMB.2.raw
  modified_base (382)..(382): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtggggtggccaaacataaaagcaaagatggaaactgccccgagttttacgnggactctgtgaggggcctttcacctatctccagagacaacgccaaagaattcaactgtatctaacaactagaacagcctgagagtcgacagacacggcgtgtacttactgtgcgagatggtaggaaaaagtatggtactgtagtttaagtggggaccaggggagcccgtggtccaccg

SEQ ID NO: 411702 - DNA, 570 bp, Homo sapiens
  misc_feature: GZ8MTXP02F94CW.17.28.C06.1.454.CMB.2.raw
  modified_base (339)..(339): a, c, t, g, unknown or other
  modified_base (375)..(375): a, c, t, g, unknown or other
  modified_base (399)..(399): a, c, t, g, unknown or other
  modified_base (402)..(402): a, c, t, g, unknown or other
  modified_base (407)..(407): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagctggtcagccgtgggggtccctgagactctcctgtgcagcctccggacttccccttcagtagttattggatgactgggtccgccagactccgaggggaggggctggagtgggtggccaaanataaagcaaagatggaactgacccgtagtttaccgngtactctgtgagggtccttcaccntcncaganacacgccaagatcatagtatcaacaatagaacagcctagagagtcgacagaccgacggccgtagtactcgtgtgcgtaagataggtaaaggtaaaaagtagtcggacgttggttagtttaaggttggggacgtaggggacgtcccgttgggtaccctacccgg

SEQ ID NO: 411703 - DNA, 667 bp, Homo sapiens
  misc_feature: GZ8MTXP02F6841.17.28.C06.1.454.CMB.2.raw
  modified_base (279)..(279): a, c, t, g, unknown or other
  modified_base (307)..(307): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgaggtccgggggagcctggtccagccgtgggggtccctgagactctcctgtgcagcctcggacttccccttnagttagttattggatgacgttgggtccncagaatccgaagggaggggctggagtgggtcggaccaaacaataaaacgacgaaagtagtacggtaactcggtacccggtttacgttttcggagtaccgtgtaggtacgggtaccgggttcctaccactactccgtacgaagacgaaaccacgaaccaagtaactacagttatactacgtaactaactacaacacgtaccgagacgtacgccgacgaacgtaccggaccgggttcttaggttaactcggttgaccgagtagtaggttaaacggtaaaaagggtaaaacttggtacgggtatttagggtttacgttaaggggtcggacggttacggggacccttcggtaccgacgtacccg

SEQ ID NO: 411704 - DNA, 588 bp, Homo sapiens
  misc_feature: GZ8MTXP02FXSMR.17.28.C06.1.454.CMB.2.raw
  modified_base (373)..(373): a, c, t, g, unknown or other
  modified_base (513)..(513): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagctggtccagcctgggggtccctgagactctcctgtgcagcctccggattccccttcagtagttatggatgacttgggtccgcagactccgagggaggggctggagtgggtgccaacataaagcaaagataggaaactgaccccgtagttttacgnggacttctggtagacggggtcctttcgaacctagtcctaccaaggacgaaccaaaccgacccaaagaaactttcaacttagtacttactaacaactagaacagcctagagagtcgacagaccacggccgtagtattacgngtgcgagatagtaaggaaaaagtagtacggcttggttgttaagttggggacctaggggactccgtggtctacccg

SEQ ID NO: 411705 - DNA, 694 bp, Homo sapiens
  misc_feature: GZ8MTXP02FIUJI.17.28.C06.1.454.CMB.2.raw
  modified_base (205)..(205): a, c, t, g, unknown or other
  modified_base (234)..(234): a, c, t, g, unknown or other
  modified_base (246)..(246): a, c, t, g, unknown or other
  modified_base (310)..(310): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccacctcagtgtctgggaccccgggnagaggtcaccatatcttgttctggaaacngctccggcatcncaactaaacattttgctggtaccagcaacttcccaggactccggccccccgactcctcatctanagaaactgatcacgtccggccccgtccggggtcccctgacccccgtactttccgtcgtcggtcctcccgattcgtccgtcggcctacccgtcacgccccttccctacgaacccacttccgaaggttcggggcccgtcccggtacccgaggtaacgtcggaacgggtctaggtaacttttaacttcccgttagggttccgtttaaaccccgggtgggggtactttaccggaactaattccccgtaaggtaaacgtttcggggttccccgggttaggtttccggggccggggaaggtaaccccgacgggtccgttacggaccccgttaccgtaaaagtcccgaacggtacccccgaaagcccgtacccggtccccccgttaccggg

SEQ ID NO: 411706 - DNA, 624 bp, Homo sapiens
  misc_feature: GZ8MTXP02FG9CY.17.28.C06.1.454.CMB.2.raw
  modified_base (235)..(235): a, c, t, g, unknown or other
  modified_base (358)..(358): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgtctggaaacngctccggcatctcaactaaactattttgctggtaccagcaattccccaggactccggccccccgactccctcatctatagaaatgatcatccgggcccctccgggggtccctgaccgattccnctggctccatgtctggccacctcagccctccctagacccatcccaggtcggggtcctcccgggtacccggagggtactcgggaggcgttgtatttacgttacgtggtacgccgtacccgggttggggacttggaccactttccgagtaacgttcgggggtcccggtcggttcgggcggggacggggacccagggccgtacggaccccgttccgtaaacggtccgaacggaccccgaacggccgtacccggccccccgtttaccggg

SEQ ID NO: 411707 - DNA, 610 bp, Homo sapiens
  misc_feature: GZ8MTXP02JRH2Y.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagcctggtccagcctgggggtccctgagactctcctgtgcagcctccggattccccttcagttagttattggatgacttgggtccgccagactcgagggaaggggctggagtgggtgccaacataaagcaaagatggaactgccccgtagtttacgtggactcgtgtgacggggtccgtttacaccgattctccagacgacaacgacccaaagattcactagtatactaacaatacgaacaagcctagacgagtcgacgaagaccgacggtacccggtagtaacgtttaccgtggtagcggagtagtaggtaagggaaaaaagttagtagggtacttggttagtttaacggtcgggggtaccgagggggacgcccgtaggggtcctaacccgg

SEQ ID NO: 411708 - DNA, 603 bp, Homo sapiens
  misc_feature: GZ8MTXP02HP3W5.17.28.C06.1.454.CMB.2.raw
  modified_base (208)..(208): a, c, t, g, unknown or other
  modified_base (238)..(238): a, c, t, g, unknown or other
  modified_base (262)..(262): a, c, t, g, unknown or other
  modified_base (275)..(275): a, c, t, g, unknown or other
  modified_base (375)..(375): a, c, t, g, unknown or other
  modified_base (381)..(381): a, c, t, g, unknown or other
  modified_base (387)..(387): a, c, t, g, unknown or other
  modified_base (392)..(392): a, c, t, g, unknown or other
  modified_base (444)..(444): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggnagagggtcaccatatcttgttctggaaacncgctccgcatctacaactaacttntttgcgtcgacanacactccgagctcccgccccctactcctcatactaataagaatgatcgacgtcccggtcccgtcccgggtccctacgaccccgtattctcgtcgtctccntcgtcncgtccncctcncgtccctcccacacctatcgacggtcggtcccgtccggtcgagcgtgacgtntagttactttacttacgttcgtacggaccgtacggtaggactacgactacgtccgtagtacggttcggggttccggtgggtccgggacgggacggacgtacggtccgtacgtaccgtaacgtacgtaccgaccggaccgtacgtccgtcccgtaccccg

SEQ ID NO: 411709 - DNA, 645 bp, Homo sapiens
  misc_feature: GZ8MTXP02FVJHB.17.28.C06.1.454.CMB.2.raw
  modified_base (276)..(276): a, c, t, g, unknown or other
  modified_base (298)..(298): a, c, t, g, unknown or other
  modified_base (329)..(329): a, c, t, g, unknown or other
  modified_base (342)..(342): a, c, t, g, unknown or other
  modified_base (364)..(364): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagccgtgggggtcctgagactctcctgtgcagcctcggattcccctnagtattatggatgacttggccncagctcgagggagggctggagtggtgccaanataaagcaaaganggaactgccccgtagtttacgngactctgtggagggtcctttacacatctacagacgacaacgccaaagtacttcactgtactactaacaactagaacagaccctaggaacgagtaccgacgaacgaccgaccggggtacccgttggtttaaacttaccgttgggtacgacgaaggtagttagggtaaacggggtaaaaaaagttaacggttcgggtaacttggggttttacggttttaaaggggtttcgggggaacccgtaagggggtaccgtccccggttacggggtacccttaaccccgg

SEQ ID NO: 411710 - DNA, 568 bp, Homo sapiens
  misc_feature: GZ8MTXP02IEF9R.17.28.C06.1.454.CMB.2.raw
  modified_base (378)..(378): a, c, t, g, unknown or other
  modified_base (410)..(410): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtgggggtccctgagactctcctgtgcagcctccggattcccctcagtagttattggatgacttgggtcccgccagacctccgagggaggggctggagtgggtggccaacataaagcaagatggaactgacccgtagtttacgngactctgtgaggggtccttcaccatctcaganacaacgaccaagattcactgtactactacaactagaacagccctgagagtcgacagaccgacggccgtagtattactgtgcgtagagtggtaaggtaaaaagtagtggtactgttagtttaagttggggaccgtaggggacgtcccgtggtcctaccg

SEQ ID NO: 411711 - DNA, 628 bp, Homo sapiens
  misc_feature: GZ8MTXP02ISUTP.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttgtgagtcgggagctgtcagcgtgggggtcctgagactctcctgtgcagcctccggacttccccttcagtagttattggatgacttggtccgccagactccgaggggaaggggctggaggtgggtggaccaacaataaagcaaagataggaaactgccccgtagttttacgtggactcgtggtgacggggtccgtttcaccgtatccgtacaagacgaacaaaccgaccaaagtaacttcaactagtactactaacaaactacgaaacacgcctagagacgtcgacgacgaacgaccggccgttagttacttacgtggtacgacggtagtagttaggtaaaggtaaaaagttacgtaggtacgttggttaggtttaaggttgggggacccgtaggggacgtcccgttacgggtacccttaacccgg

SEQ ID NO: 411712 - DNA, 784 bp, Homo sapiens
  misc_feature: GZ8MTXP02IADVN.17.28.C06.1.454.CMB.2.raw
  modified_base (586)..(586): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaagtgtccagtgtgaggtccagttggttgaggtcggggagccgtggtccagccgtgggggtcctgagactctcctgtgcacgcctccggtacttccccttctagttagttagttggagtgtacgttcgggtcccgccgagacctaccggaggggacgggggtcgtgggaggtggggtcggaccaaaagagtaaaaggcgaaaggagtacggaaactcggtaccccggttaacggtttttaaccggtcggtaaccgttcgttagggttacgggtaaccggggtcccggtttttaccaaccctaacttcccgtaccgaacggaaaccgaaacccgaaaccgaaccctaaagtaaactttacccgaagtttacgttaaacttacctaaaccgtaaacctacgtaaaaccncgtacccgttaggaacggtacgtacgaccgaaaggacccggtaccgggtaccggtagttaacgtttaccgtggtacggacgtaagtaggttaagggtaaaagtaaaaaacggttacgtggtacgtttggttaggggttttaacggtacgggggtaccggaacggggtaccgtcccggttacggttcccgtaaccccgg

SEQ ID NO: 411713 - DNA, 626 bp, Homo sapiens
  misc_feature: GZ8MTXP02GCUUJ.17.28.C06.1.454.CMB.2.raw
  modified_base (284)..(284): a, c, t, g, unknown or other
  modified_base (309)..(309): a, c, t, g, unknown or other
  modified_base (344)..(344): a, c, t, g, unknown or other
  modified_base (378)..(378): a, c, t, g, unknown or other
  modified_base (384)..(384): a, c, t, g, unknown or other
  modified_base (467)..(467): a, c, t, g, unknown or other
tcagcgtagactagcacgaccggtgctcgatttagagctcacgtattgggtttggggaggtctcagagagggaggcttagccctggaatccaaggcctttccacttggtgatcagcactgagcacagaggactcaccatggagttggggctgaacttgggttttccttgttgcttgttttagaaggtgtccagtgtgaggtccagttggttgaggtccgggggagcctggtccagccgtgggggtccctgagactctcctgtgcagccctcggacttccccttnagtagttatggatgtactgggtccncagacctccgagggagggctggagtgggagccaanagtaaagcaagatggaatgccccgtagtttacgngacttntggtaggaggggtccttacacgtactcctacagacgacaacgaccaaagtacttacattagtactactaacaactacgaaacncgtacctagaaggacgtaccgacgtagacccgacgggtaccgttagtaacttacgtggtagacgtagtagtaggtaaaggtaaaaagtagtgggtaccgttggtttacggtttaagtcggggtacgtaacgggggtctcccggtagggtcctaacccgg

SEQ ID NO: 411714 - DNA, 555 bp, Homo sapiens
  misc_feature: GZ8MTXP02J1IE1.17.28.C06.1.454.CMB.2.raw
  modified_base (377)..(377): a, c, t, g, unknown or other
  modified_base (398)..(398): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctgggggtccctgagactctcctgtgcagcctccggattccccttcagtagttattggatgacttgggtccgccagactccgagggaaggggctggagtgggtggccaacataaagcaaagatggaactgccccgagtttacgnggactctgtgagggccgtttnaccatctcagagacaacgccaagaattcactgtatctacaactgaacagacctgagagtcgccgagacgacggaccgtgtattactgtgcgagatagaggaaaatacgtagcttgtagtttaagtggggtaccaggggacgcccgtaggtctacccg

SEQ ID NO: 411715 - DNA, 642 bp, Homo sapiens
  misc_feature: GZ8MTXP02H2I5A.17.28.C06.1.454.CMB.2.raw
  modified_base (374)..(374): a, c, t, g, unknown or other
  modified_base (390)..(390): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgttttagaaggtgtccagtgtgaggtcagttggttgaggtccggggagcctggtcaggccgtgggggtcctgagactctcctgtgcacgcctccggtacttccccttcagtagttagttggatggtacttgggtccgccagacctccgaaggggaggggctggaggtgggtcggacaaacataaagcaaagatggaaacngcccggtagtttacgngactcgtggtaggacgggtccgtttcaccgttatcctacgagaacgacctaaacggaccaaagtaacttcaacttgtaactactaacaactagaaacagccgttagacgtagtacgacgacggacaccgggaccgttgtaacttacgtgtcgacgagtaagtaggtaaaggtaaaaaggtagtacgggtcttaggtttaggtttaaggttcgggggacgtacgggacggtcccgtacggtttaccgaccccg

SEQ ID NO: 411716 - DNA, 681 bp, Homo sapiens
  misc_feature: GZ8MTXP02IBKTG.17.28.C06.1.454.CMB.2.raw
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagcccaccctcagtgtcgtcggggacccccggcaggacgggtcaccatatcttgttctaggaaacagctccggcatctacaactaaactattttgctcggtaccagtacctaacttcccgaggaacctccccggcccccccgtactcccctacactactaataagaatgatcgactccggcccgtccgggtcctcgaccgtacttctctcgctctattcgtctcgcctaccctcaccgtcccctccgtaccacctacgtcgacggtcggtcccgtccggtccgaaggcgtgggacgtctagtactttacgttacgtggttacgacgtacgggtagggtactacgtaactacgttcccgtagttaaccgggttcgggtcccgggtttcgggtcggggaccggggaaccggtaccgaacggggtccgttccgggtaaacccgttaccgtaaacggtccgaaacccggtacccggaacggtccccgtaccccggtacccccgttacgg

SEQ ID NO: 411717 - DNA, 657 bp, Homo sapiens
  misc_feature: GZ8MTXP02H551Z.17.28.C06.1.454.CMB.2.raw
  modified_base (543)..(543): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtgggggtccctgagactctcctgtgcacgcctcccggacttcccccttcagtagttattggatgtactgggtccgcagacctccgaggggaaggggcgtgggaggtggggtcggaccaaacaataaaagcaaagataggaactggccccgtagttttacggtggactcgtggtaggaggggtcccgttttcgaccctatcctacccgagaacgaccaacgacccaaagaacttcactagtactctaacaactcgaacagcctagagacgtaccgcgaagaccgaccggccgttagtaacgtttacgnggtcgacggtagtagtaggtaaagggtaaaaaagtaacgttggacgttggtttaggtttaaggttcgggggtacccgtaggggaccggccccgtttagggttaccctacccccg

SEQ ID NO: 411718 - DNA, 544 bp, Homo sapiens
  misc_feature: GZ8MTXP02HCTTP.17.28.C06.1.454.CMB.2.raw
  modified_base (299)..(299): a, c, t, g, unknown or other
  modified_base (365)..(365): a, c, t, g, unknown or other
  modified_base (500)..(500): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattccccttcagtagttattggatgacttgggtccnccagactccagggagggctggagtgggtggcaacataaagcaagatggaactgccgagttttacgnggactctgtagaagggtccgtttcacctagtctccagagacaacgccaaagaattcactgtatctacaactgaaacagcctgagagtcgacagacacggccgtagtattactgtgcgagagtgtaggaaaaatanggcttgtgtttagtggggctagggacgtccctggtcaccggtcc

SEQ ID NO: 411719 - DNA, 578 bp, Homo sapiens
  misc_feature: GZ8MTXP02JEXIQ.17.28.C06.1.454.CMB.2.raw
  modified_base (380)..(380): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcgacagaggacgtcaccatggagttgggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaaagatggaactgccccgagttttaccgnggactctgtgaggggccgtttcaccatctccagagacaacgccaaagaattcactgtatctacaactgaacagacctggagagtcgacgaacgacgacgggccgtaggtacttacgtgtcgcgacgagtagtaaggtaaaagtaaagtagtacgtgttgttaagttgggtacggacggacggccgtcggtcgtacccg

SEQ ID NO: 411720 - DNA, 623 bp, Homo sapiens
  misc_feature: GZ8MTXP02FM7LU.17.28.C06.1.454.CMB.2.raw
  modified_base (208)..(208): a, c, t, g, unknown or other
  modified_base (239)..(239): a, c, t, g, unknown or other
  modified_base (372)..(372): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtctcgggacccccggnaggaggtcaccatatcttgttctaggaaacngctccggcatctacaaactaactattttgctgtaccagctaacttcccgaggactcccggccccccgtatcctcatctaataagaaatgactcacgtccggccccgtccggggtcccctgaccccgtattccncgtcggcctccagttcgtccgtcggccaccctcacgtccctccctacgacctactcgacggtcggccgtcccggtaccgaggtactggacgtctagtattattacgtgtacgttaccgggtggtactggactgtccgtaggtaacgtcggggttcggttacgggttccggggacgggtacgggaccgacgggtccgtacggtacccgttacgtaacgtcgacgtacccgaggtcctaccggccccgttcgg

SEQ ID NO: 411721 - DNA, 571 bp, Homo sapiens
  misc_feature: GZ8MTXP02HWT6E.17.28.C06.1.454.CMB.2.raw
  modified_base (375)..(375): a, c, t, g, unknown or other
  modified_base (380)..(380): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggagcctggtccagcctgggggtccctgagactctcctgtgcagcctccggattccccttcagtagttattggatgacttgggtccgccagactccgagggaaggggctggaggtgggtgaccaacataaagcaaagatgactgcccgtagtttacgngactntgtgacgggtcctttcactactctcagacgacaacgaccaagaatacactgtaatctaacaaactagaacagccgtgacgagtcgacgagacgacggccgttagtattacgtgtgacgagatggtaaaggtaaaaagtataggtcttggttagtttaaggttggggcgtagggacgtcccggtagtacacg

SEQ ID NO: 411722 - DNA, 586 bp, Homo sapiens
  misc_feature: GZ8MTXP02HXXJJ.17.28.C06.1.454.CMB.2.raw
  modified_base (303)..(303): a, c, t, g, unknown or other
  modified_base (375)..(375): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagccgtggggggtccctgagactctcctgtgcagccctccggacttccccttcagtagttatggatgacttgggtccnccagactccgagggaaggggctggagtgggtgccaacataaaagcaagatggaactgccgtagtttttacgnggactcgtgtgaagggtccgtttcaccatcctccagacacaaccgacaaagaattcactgtaacttctaacaaactcgaaacacgcctagagagtcgacagaccgacggccgtgtaacttactagtgcgatatagtaggaaaaagtagtagcgttagttggtttaagttgggggccctaaggggtcgacccgtggttaccgtaccgttccc

SEQ ID NO: 411723 - DNA, 640 bp, Homo sapiens
  misc_feature: GZ8MTXP02H8AGN.17.28.C06.1.454.CMB.2.raw
  modified_base (211)..(211): a, c, t, g, unknown or other
tcagcgtagactagcacgaccggtgctcgatttagagctcacgtattgggtttggggcagcttcagctgtggtagagaagacaggattcaggacaatctccagcatggccggcttcccctctcctcctcacccctcctcactcactgtgcagggtcctgggcccagtttgtgctgacctcagccaccctcagtgtctcggggacccccggnaggagggtcaccatatcttgttctaggaaacagcctccggcatctacaactaaactattttgctggtaccagctaactcccaggactcccggcccccccgatccctctatctaataagaaatgactcacgtccggccccgtccggggtccctgaccgtctctccgtcgcctctattcgtcgtcgtcacccgtcacgtccctcctcgaccctatcgtaggtcggtccctcccgggtacgaggtacgtggacggtctagtaattacttacgtgttcgacgtacgggtgggactcggactacgtcgtaggaacgtcggtccggttacggtcgggaccggggtacggaccgtacgggtccgtacggtacccggttaccgtaacggtccgaaccggtacccgaacgggtcccctcccggttacccccgttccgg

SEQ ID NO: 411724 - DNA, 628 bp, Homo sapiens
  misc_feature: GZ8MTXP02JJYMC.17.28.C06.1.454.CMB.2.raw
  modified_base (306)..(306): a, c, t, g, unknown or other
  modified_base (337)..(337): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctggggggtccctgagactctcctgtgcagccctccggattccccttcagtagttattggatgacttgggtccnccagactccgagggaggggctggagtggggnggccaaacataaagcaaagatggaactgaccccgtagttttacgtggactcgtgtgacggggtcctttcgaccatctccagagacaacgccaaagaattcactgtatctaacaactagaaacacgccctggaacgagtaccggacacgaccaccgggccggttagtactttacgtgtacgacgagtagtaggtaaaggaaaaagttaacgtgggtacgttaggtttaggttttaacggttcggggggacctagggggtaccgtacccggttcggggtaccttaaccccggg

SEQ ID NO: 411725 - DNA, 555 bp, Homo sapiens
  misc_feature: GZ8MTXP02FP7TZ.17.28.C06.1.454.CMB.2.raw
  modified_base (205)..(205): a, c, t, g, unknown or other
  modified_base (235)..(235): a, c, t, g, unknown or other
  modified_base (413)..(413): a, c, t, g, unknown or other
  modified_base (449)..(449): a, c, t, g, unknown or other
  modified_base (495)..(495): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggnagagggtcaccatatcttgttctggaaacngctccggcatctcaactaaacattttgctggtaccagcaattcccaggactccggccccccgatccctcatctatagaaatgatcatccggccctccggggtccctgaccgattctctggcctcatgtctggcacctcacgcctccctgacccatcagtcggctcccgggtccgaggntgagctgattatactgtcgcgaccggtggatgaacnctcctgtaagtcgggttccggtggttcgggacgggtacgggacccngggcctcgacccgttaccgtaaagtccaacggcccccgaaggtcctccggcccccgtcgg

SEQ ID NO: 411726 - DNA, 585 bp, Homo sapiens
  misc_feature: GZ8MTXP02IBP1M.17.28.C06.1.454.CMB.2.raw
  modified_base (377)..(377): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggttttccttgtgctgttttagaggtgtccagtgtgaggtcagttggtgagtccgggggagctgtccagccgtgggggtccctgagctctcctgtgcacgcctccggacttccccttcagttagttattggattgacgttcgggtccgccagacctccgagggaggggctggagtgggtgccaacataaagcaaagataggaactgccccgtagttttacgnggactgtgtagaggggtccgtttacaccgtatcctacagacgacaacgaccaaagaattacaacttgtatctaacaactagaacagccctaggagagtcgcgagacgacggcttgtacttacgtgtgcagtagtaggtaggtaaaaagtagtacggacttagttagtttaaggtcggggacgaggggactcccggtacgtcgtacccg

SEQ ID NO: 411727 - DNA, 771 bp, Homo sapiens
  misc_feature: GZ8MTXP02F21CQ.17.28.C06.1.454.CMB.2.raw
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccggcaggaggtcaccatatcttgttctaggaaacagcctccggcactctacaaacttaaactattttgctaggtaccagctaacttcccaggactcccggccccccactcctcatctataagaaatgatcacgtcccggccccgtccggggtcccctggaccccgtattccgtctggcctccatcgtctcggacctacccgtcacgccctccctcgaccctatccgtaaggtccgggtacccgttcccgggtacccggaggtacgtacgggtacggtaccgttaggttaacgttttaacgtttaaccgttcgggttacgtaccccggttaaaccggggttcggggtaacgttaccggtaaccgttaaaccgttcccgttaaacgggtaacgggtttccgggggtttacccgggggtttacgggggtttcccgggggtaaccgggggtaaaccggggtacccgggtaccggggtacccgttaaccgggtaaccccggttaaccgttaaccggttacccgaacccgggttacccccgaaacgggtccccgttccccggttaccccccgg

SEQ ID NO: 411728 - DNA, 670 bp, Homo sapiens
  misc_feature: GZ8MTXP02JCZUW.17.28.C06.1.454.CMB.2.raw
  modified_base (186)..(186): a, c, t, g, unknown or other
  modified_base (205)..(205): a, c, t, g, unknown or other
  modified_base (282)..(282): a, c, t, g, unknown or other
  modified_base (308)..(308): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccacctnagtgtctcgggaccccggnagaggtcaccatatcttgtctaggaaacagctccggcatctacaactaaactattttgctgtacagcaatccagacncccgccccgactcctcatctactaanaatgatactacgtcccggtcccgtcccggggtccctacgtaccccgtacttccgtcgtcggccttaccgtacttcgtccgtggacccacctaccgacgtcccctccctacgaccctatccgaggtcgggtcctcccgggacgacgggatggaggtctagtattacgttactggtaccgtacggaccggtggtacgtacgtacgttacgtcccgtaaggtaaacgggttcggggtttacccgggttgggttaccgggggtaccgggaaaacggggtccgacggggttaccgtaccggtacccgttaaccggtacgttacccggacgaaccccggaacggtcccggttaacccgttcccccggg

SEQ ID NO: 411729 - DNA, 652 bp, Homo sapiens
  misc_feature: GZ8MTXP02IHWWJ.17.28.C06.1.454.CMB.2.raw
  modified_base (520)..(520): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcacgcccaccctcagtcgtcgtcgggaccccgggcaggacggtcaccatattcttgttctaggaaacacgctccggcatctactaaactaaacttattttgcgttaggtaccagtacctaacttcccgaaggtaccgtccccggacccccctactcctacactactaataagtaaatgaactcgtacgtcccggtccccgtcccggggtaccctacggtaccccgtacttcctcgtcgtccttccattcgtcgtcgaccctaccgtccacgtccctcccgtacgaccatacgtacggtcgggtacccgtccgggacgtaggagtcggacgtcgtagtaactttntacgtgtacgtcgtacggtggactcgactctcgtagtacgttcggtcggtggttacgggacggacggacgacgtacgttacgaaccgtaacgtacggtaccgtaccgaccgacggtccctcccggtaccccg

SEQ ID NO: 411730 - DNA, 546 bp, Homo sapiens
  misc_feature: GZ8MTXP02FQ147.17.28.C06.1.454.CMB.2.raw
  modified_base (371)..(371): a, c, t, g, unknown or other
  modified_base (480)..(480): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagtggttgagtccggggagcctggtccagcctgggggtccctgagactctcctgtgcagcctccggattccccttcagtagttattggatgacttgggtccgccagactccgaggggaaggggctggagtgggtggccaacataaaagcaagatggaactgccgtagttttacgnggactctgtgaacgggtccgtttcacctatcctccagagacaacgccaaagattcatgtatctacaactgaacagcctgagagtcgcagacaccggccgtagtattacngtgcgagatggtaaggaaaagtatggcttgtgtttagtgggacaggggacgcccgtggccacgtcc

SEQ ID NO: 411731 - DNA, 611 bp, Homo sapiens
  misc_feature: GZ8MTXP02FIJ8Z.17.28.C06.1.454.CMB.2.raw
  modified_base (239)..(239): a, c, t, g, unknown or other
  modified_base (362)..(362): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtctcggggacccccgggcagaggtcaccatatcttgttctggaaacngctccggcatcacaactaaactattttgctggtaccagcaacttccccaggactccggccccccgactcctcatctatagaaatgatcagtccggccccgtccggggtcccctgaaccccgtnttcctctgctccatcgtctggcaccctcacgccctccctgacccatcgaggtcggcccgtccggtccgaggactggacggcttaggacttagttacgtgtacgccgacggtcggggaattcggaacctacgttcccgagtacggtccggggtcgttacgggtccgggacggagggacccgacgggtcctcggtaacccgttccgaacgtacccgaccggaccctaagggcccgtacccggtccccccgg

SEQ ID NO: 411732 - DNA, 595 bp, Homo sapiens
  misc_feature: GZ8MTXP02JLMVK.17.28.C06.1.454.CMB.2.raw
  modified_base (237)..(237): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggcagagggtcaccatatcttgtctggaaacngctccggcatctcaactaaactattttgctggtaccagacaattccccaggactccggccccccgactcctcatctaatagaaatgtatcagtccggcccgtcccggggtccctcgaccccgtattcctctcggcctccatcgtctggccacctcacgcctccctcgaccactcacgtcgggtccgtccggtccggacggacgtgacggcgtgtattattacgttgtgtcgaccgtcggagtacgacactccgtagtaacgtcggtccgggtcggttcgggtcggggacggggaaccggacggtacgtcgaccggtaaccgtaacgtacgacgaccgaacggaccgtccgtcccccgg

SEQ ID NO: 411733 - DNA, 735 bp, Homo sapiens
  misc_feature: GZ8MTXP02I3E5L.17.28.C06.1.454.CMB.2.raw
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtcgctgactcagcccaccctcagtgtcgtcgggacccccggcagagggtcacctatatcttgttctaggaaacagctccggcatctacaaactaaactattttgctaggtaccagctaacttcccaggctccggcccccgactcctcactctatagaaatgaatcacgtcccggcccgtaccggggtccctcgtacccccgtactttccgtcgtcggccttcccgattccggtcttcgggccctaccccgttcgacccggtcccctccccgttacgacccctaagtcccgtaacggggttccgggcccgttacccggggttacccggaaggtacgtacgggaacggtccttaggtaacttttaacgttaccgttcgacgtcccggtaacggtcggggtacttaccgggacctacttcccgtaggtaaaccggttcggggttcccggttagggttaccgggggaccgggtaagggtaccgacggggtaccttaccggggaaaaccgttaacccgtaaaagtccggaaaccgtaccccggtaacggcccgttacccggtacccccccgg

SEQ ID NO: 411734 - DNA, 560 bp, Homo sapiens
  misc_feature: GZ8MTXP02JEAQI.17.28.C06.1.454.CMB.2.raw
  modified_base (491)..(491): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagctggtccagcctgggggtccctgagactctcctgtgcagcctccggattccccttcagtagttattggatgacttgggtccgccagactccgagggaaggggctggagtgggtggccaaacataaagcaaagatggaaactgccccgtagttttacgtgactcgtgtgaggggtcctttacaccatctccagagacaacgccaagaatcactagtactctaacaactagaacagacctgaagagtcgacgagacgacggcgtgtattacgngtgcgagagtagtaaggaaaagtagtcgattgttagttaagtggggcgagggcgtccgtcggtctaccg

SEQ ID NO: 411735 - DNA, 549 bp, Homo sapiens
  misc_feature: GZ8MTXP02JNS0J.17.28.C06.1.454.CMB.2.raw
  modified_base (269)..(269): a, c, t, g, unknown or other
  modified_base (324)..(324): a, c, t, g, unknown or other
  modified_base (331)..(331): a, c, t, g, unknown or other
  modified_base (368)..(368): a, c, t, g, unknown or other
  modified_base (375)..(375): a, c, t, g, unknown or other
  modified_base (389)..(389): a, c, t, g, unknown or other
  modified_base (433)..(433): a, c, t, g, unknown or other
  modified_base (458)..(458): a, c, t, g, unknown or other
  modified_base (495)..(495): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtcagtgtgaggtcagttgtgagtcggggagctggtcagcctgggggtcctgagactctcctgtgcagcctccggattccccttnagtagtattggatgacttgggtccgcagacctcgagggaaggggctggagtgggngccaaanataaaagcaaagatggaaactgaccccgagtttacgngactcgngtgagggccgtttnaccatctacagagaacaaacgacccaaaagacttcaactagtanactaacaaactagaacaaacgaccngaagagacggacagacgacggaccgtagtatatgtgngagatagtagaaaagtaaatagctgtgttaagtggtcgaggagctcgcgtaccg

SEQ ID NO: 411736 - DNA, 713 bp, Homo sapiens
  misc_feature: GZ8MTXP02HD84F.17.28.C06.1.454.CMB.2.raw
  modified_base (387)..(387): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagccgtggggggtccctgagactctcctgtgcagcctccggacttccccttcagtagttatggatgacgttgggccgccagactccgaggggaaggggctgggaggtggggtcggaccaaagataaagcaaagatggaaactgccccgtagtttacgnggactcgtgtacggaggggtcccgtttacaccgtatcctacccgagacgaaccgaaaccgacccaaagtaactttaccaacttacgtaactaccttaaacctaaaaccgttacgaaaacctacggtaccccgttaggaacgggtacggtaccggacgaacggaacccgacccggggtacccggttaggttaactttaccggtggtacgacggtaaggtaagtttagggtaaaaggggtaaaaaagttacgtagggtacttaggtttaggttttaacggttcgggggaccgtagggggtaccgtccccgttaggggtcctaacccgg

SEQ ID NO: 411737 - DNA, 658 bp, Homo sapiens
  misc_feature: GZ8MTXP02JVSAV.17.28.C06.1.454.CMB.2.raw
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtcgtcgggaccccccgggcaggagggtcaccatatcttgttctggaaacagctccggcatctacaaacttaaattattttgcttggtaccagactaacttccccaggactcccggccccccactcctcatctatagaaatgatcagtccggccccgttccggggtcctcgaccccgtattctctcggctccatcgtctggcctacctccacgccctccctgaccctatccgaggtcgggccctcccgggtccgaggactgggagtctagtatttacgtttacgtgttcgaccgtaccgggttagggaacttcggaaccttacgtcccgtagggtaaacgttcggggttcccgggttgggttacggggacggggtaaccggggaccgaacgggtccgtaccggtaacccgttaaccgtaaacggtccgaaccggaccccgaacggtcccgtaccccggtccccccgg

SEQ ID NO: 411738 - DNA, 591 bp, Homo sapiens
  misc_feature: GZ8MTXP02FZZC3.17.28.C06.1.454.CMB.2.raw
  modified_base (336)..(336): a, c, t, g, unknown or other
  modified_base (349)..(349): a, c, t, g, unknown or other
  modified_base (370)..(370): a, c, t, g, unknown or other
  modified_base (375)..(375): a, c, t, g, unknown or other
  modified_base (378)..(378): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttgttgagtcggggagctggtccagcctgggggtccctgagactctcctgtgcagcctccggattccccttcagtagttattggatgacttgggtccgccagactccgaggggagggctggagtgggtgccaanataaagcaaaganggaactgcccgtagtttacgngactntgngagggccttcacatctcagagacaacgaccaagaattcactgtatactaacaactagaaacagcctaggagagtcgacaagaccgacggccgttagtactttactgtcggacgtaagtagttaggtaaagggaaaaaagttagtacgggtacgttggttagttttaaggtcgggggtacccagggggacgtccccgtgggtacctaaccccgg

SEQ ID NO: 411739 - DNA, 563 bp, Homo sapiens
  misc_feature: GZ8MTXP02H7CAG.17.28.C06.1.454.CMB.2.raw
  modified_base (244)..(244): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctaaccctcctcactcactgtgcagggtcctgggcccagtctgtgctgactcagccaccctcagtgtctgggacccccgggcagagggtcaccatatcttgttctggaaacagctccggnatctcaactaaactatttttgctggtaccagcaattcccaggatcggccccccgactcctcatctatagaaatgatcatcggccctccggggtcctgaccgattcctctgctccatgtctggcacctcacgccctcctgacccatcacgtgggctccgggtccgaggatgaggtctagattatactggtcgcgaccgttgggatcgacacgttccgtagtaagtcgggttcggtcggtttcgggcgggagggaccgagggcttcggaccgttccgtaaacgtcgacgacccgtaacgggcctccgcccccgtggttccc

SEQ ID NO: 411740 - DNA, 617 bp, Homo sapiens
  misc_feature: GZ8MTXP02JFWNJ.17.28.C06.1.454.CMB.2.raw
  modified_base (378)..(378): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctgggggtccctgagactctcctgtgcagcctccggattccccttcagtagttattggatgacttgggtccgccagactccgagggaaggggctggagtgggtgtccaacataaagcaaagatggaactgccccgtagttttacgnggactcgtgtagacggggtcctttacacctatcctaccaagacgaacaaacggacccaaagtaaactcaactgtactcctaacaactacgaaacagcctagagagtcgcagtaccgacggcgtgtacttactgtgacggagagttggtaaagggtaaaaagtagtcggacgttaggttaggttttaaggtcgggggtacccgaagggggtaccgtcccggttagggtaccctaacccgg

SEQ ID NO: 411741 - DNA, 597 bp, Homo sapiens
  misc_feature: GZ8MTXP02JTY34.17.28.C06.1.454.CMB.2.raw
  modified_base (381)..(381): a, c, t, g, unknown or other
  modified_base (472)..(472): a, c, t, g, unknown or other
  modified_base (530)..(530): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtgggggtccctgagactctcctgtgcagcctccggattccccttcagtagttattggatgacttgggtccgccagactccgaggggaaggggctggagtgggtggccaacataaagcaaagatggaactgccccgtagttttacgnggactctgtgacgggtccgtttcaccgatctccgagagaacaacgaccaagaacttcactgtatctaacaactagaacagctgagagtcgnagaccgacggtccgtagtattaactgtgcgtaagataggtaaaggaaaaagttaacgngggtacttaggtttagtttaacggttcgggggaccagggggtacctcccgtgggttacctaccccgg

SEQ ID NO: 411742 - DNA, 565 bp, Homo sapiens
  misc_feature: GZ8MTXP02F2QXK.17.28.C06.1.454.CMB.2.raw
  modified_base (273)..(273): a, c, t, g, unknown or other
  modified_base (297)..(297): a, c, t, g, unknown or other
  modified_base (370)..(370): a, c, t, g, unknown or other
  modified_base (375)..(375): a, c, t, g, unknown or other
  modified_base (389)..(389): a, c, t, g, unknown or other
  modified_base (401)..(401): a, c, t, g, unknown or other
  modified_base (475)..(475): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagctggtccagcctgggggtccctgagactctcctgtgcagcctcggattcccctnagtagttatggatgacttggtccncagactccgagggaaggggctggagtgggtggccaacataaagcaaagatggaactgaccccgtagtttacgngactntgtgagggtccttnaccatctcaganacacgaccaagattcactgtatctaacaactagaacagcctagagagtcgacagaccgacggccgtagtatacngtgcgagataggtaaggaaaaagtagtacgtacgttggttagtttaacgtcgggggacgtacggggacgtacccgtcggtacgtaccccg

SEQ ID NO: 411743 - DNA, 600 bp, Homo sapiens
  misc_feature: GZ8MTXP02GC9C3.17.28.C06.1.454.CMB.2.raw
  modified_base (275)..(275): a, c, t, g, unknown or other
  modified_base (348)..(348): a, c, t, g, unknown or other
  modified_base (371)..(371): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggagctggtccagccgtgggggtcctgagactctcctgtgcagcctcggacttccccttnagtagttatggatgacttggtccgccagactccgagggaggggctggagtgggtgccaacataaagcaaaganggaactgacccgtagttttacgnggactctgtagacgggtcctttcaccatcctcagacacaacgccaaagaacttcaactagtatactaacaactagaacagcctagagagtacgacgaagaccgacgggccgttagtaacttcgtaggtgacgaagtagtaggtaaaggaaaaagttagtacggtacgttggttagtttaaggttcgggggaccgtaagggggccgtacccggtcggtaccgtaccccgg

SEQ ID NO: 411744 - DNA, 624 bp, Homo sapiens
  misc_feature: GZ8MTXP02GSLT4.17.28.C06.1.454.CMB.2.raw
  modified_base (236)..(236): a, c, t, g, unknown or other
  modified_base (255)..(255): a, c, t, g, unknown or other
  modified_base (266)..(266): a, c, t, g, unknown or other
  modified_base (290)..(290): a, c, t, g, unknown or other
  modified_base (299)..(299): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggcagagggtcaccatatcttgtctggaaacngctcgcatcacaactaatntttgctgacancactccagctcccgccccactccncatactaanaagaatgatcacgtccggccccgtccgggtcctcgacccctattcctcgtcgcctcacttcgtctcggcctaccctccaccgtcccctcccgtacgtaaccctacgtaccgtagggtccggggtcccgttcccggggtaccggaacgggtacgtacgggacggtcttaagttaacgtttaacgttacgttggtaccgtaccggtaccggtagggtactacggtaacctacgtccgtagtacggttcgggtccgggtggtccgggacggacgggacgcggtctacgtaccgtaacgtaacgcgacgaccgacggcctcccgtcccg

SEQ ID NO: 411745 - DNA, 541 bp, Homo sapiens
  misc_feature: GZ8MTXP02IY2EV.17.28.C06.1.454.CMB.2.raw
  modified_base (234)..(234): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtctgggaccccggcagaggtcaccatatcttgtctggaaacngctcggcatctcaactaaacattttgctggtaccagcaacttccccaggactccggccccccgactcctcatcctaatagaaatgatcatccggccctccggggtcctgaccccgtattcctctcgctccatgtctggccacctcacgccctccctgaccatcacgtggcctccggtccgaggatgaggctgattattactgtgcaccgtgggatgactatcctagaagtcggtccggtggttcggcggacgggaccacggtctcgaccgtccgtaaacgtccacgcccaaacggtctccgtccccg

SEQ ID NO: 411746 - DNA, 583 bp, Homo sapiens
  misc_feature: GZ8MTXP02FHZ93.17.28.C06.1.454.CMB.2.raw
  modified_base (377)..(377): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagcctggtccagcctgggggtccctgagactctcctgtgcagcctccggattccccttcagtagttattggatgacttgggtccgccagactccagggaaggggctggagtggtggccaacataaagcaaagactggaaactgaccccgtagttttacgnggtactctgtgaggggtccgtttcacctagtcctaccgagacgaacaacgacccaaagaactttcacttgatctaacaactagaacagccctagacgagtcgcaagaccacgggcctgtactacgtgtgacgtagagttgaagggaaaaagtagtggactaggttagttaagttgaacggtccgaggggtacgccgtcgggtaccc

SEQ ID NO: 411747 - DNA, 600 bp, Homo sapiens
  misc_feature: GZ8MTXP02HUW7U.17.28.C06.1.454.CMB.2.raw
  modified_base (343)..(343): a, c, t, g, unknown or other
  modified_base (378)..(378): a, c, t, g, unknown or other
  modified_base (388)..(388): a, c, t, g, unknown or other
  modified_base (401)..(401): a, c, t, g, unknown or other
  modified_base (465)..(465): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggagcctggtccagccgtgggggtccctgagctctcctgtgcagcctccggattccccttcagtagttattggatgacgttggtccgccagactccgagggaaggggctggagtgggtggccaanataaagcaaagatggaactgccccgtagtttacgnggactcgtgngagggtccgtttnacctatctccagagacaacgccaagaatcactgtatctacaactgaacagtcctagacaggtcncgaacgacgtacggaccgttaggtattaccgtggtgacggtagtatagggtaaaggaaaaagtttaagccggtacgttggtttagtttaacggttcgggggacctaggggacgtcccgttagggtccctacccgg

SEQ ID NO: 411748 - DNA, 600 bp, Homo sapiens
  misc_feature: GZ8MTXP02GR5L7.17.28.C06.1.454.CMB.2.raw
  modified_base (381)..(381): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggttgagtcggggagcctggtccagccgtgggggtcctgagactctcctgtgcacgcctccggacttccccttcagttagttattggatgacgttgggtccgccagactccgaggggaagggctgggaggtgggtgaccaaacataaagcaaagagtgaactgacccgtagtttacgngactctgtgaggggtccttacaccatctcagacaacaacgaccaaagattacactagtactctaacaactagaacagcctagagagtcgacaacgaccgacggtccgtagtattacgtgtacgcgtaagagtaggtaaaggaaaaagtagtcggtacgttggtttagtttaaggttcgggggacgtacggggacgtcccggttacggtaccgtaccccg

SEQ ID NO: 411749 - DNA, 651 bp, Homo sapiens
  misc_feature: GZ8MTXP02FMKE3.17.28.C06.1.454.CMB.2.raw
  modified_base (271)..(271): a, c, t, g, unknown or other
  modified_base (297)..(297): a, c, t, g, unknown or other
  modified_base (335)..(335): a, c, t, g, unknown or other
  modified_base (369)..(369): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtcagtggttgagtcggggagcctggtccagccgtgggggtccctgagactctcctgtgcagcctccggattccccttnagtagttattggatgacttgggtccnccagactccgaggggaagggctggagtgggtggccaanataaagcaagataggaactgccgtagttttacgnggactcgtgtgaagggtccgtttcacctatcctccagagacaaacgcaaagaattcactgtatctaacaactgaaacagacctgaagacgtaccgacacggaccgaccgggtcccgttagttaacgtttaaccgtggttacggacggaaggtaagttaagggtaaacgggtaaaaaaaaggttaaaggtcgggtaacgtttgggtttaggtttttaaggttcggggggacccgtaagggggtacgtcccccggttagggttacccgtaacccggtttccccg

SEQ ID NO: 411750 - DNA, 601 bp, Homo sapiens
  misc_feature: GZ8MTXP02FR8O8.17.28.C06.1.454.CMB.2.raw
  modified_base (274)..(274): a, c, t, g, unknown or other
  modified_base (298)..(298): a, c, t, g, unknown or other
  modified_base (369)..(369): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggtgagtcggggagctggtccagccgtgggggtccctgagactctcctgtgcagcctccggattccccttnagtagttatggatgacttggtccncagactccgagggaaggggctggagtggggtgaccaacataaagcaagatgaactgacccgtagtttacgnggactctgtagagggtcctttacgacctatctaccagacgacaacgaccaaagtaattcactagtaacttacctaaacaactacgaaacacgtccgtagagacgtcgacaagaccgaacgggtccgtagtaattacgtgtacgcggaaagtataggtaaagaaaaagtacgtcgggacttggttagtttaaggttcggggaccgtaggggacgtccgtcggtacgtaccccg

SEQ ID NO: 411751 - DNA, 677 bp, Homo sapiens
  misc_feature: GZ8MTXP02H5A91.17.28.C06.1.454.CMB.2.raw
  modified_base (276)..(276): a, c, t, g, unknown or other
  modified_base (399)..(399): a, c, t, g, unknown or other
tcagcgtagactagcacgaccggtgctcgatttagagctcacgtattgggtttggggctcagagaggaggcttagccctggactccaaggccttttccacttggtgatcagcactgagcacagaggactcaccatggagttggggctgaactgggttttccttgttgctgttttagaaggtgtccagtgtgaggtcagttggtgaggtccggggagcctggtccagccgtgggggtccctgagactctcctgtgcacgcctccggacttccccttnagttagttattggatgtacgttcgggtcccgccagacctccggaggggaacggggcgtggaggtcggggtcggaccaaaacgagtaaaagcgaaagataggaaactgaccgttagttttacgnggtactcgtggtaggaacggggtcctttacacctatcctaccgagtacaacaaccgacaaagtacttacactagtactactaacaactagaacgagaccgtaggaacgtacgtacgacacggaccgaaccggggtccgtagtttaagttacgtggtacgacggtaagtaaggtagggtaaaaggtaaaaaacgttaggtaaggtcgttaggtttaggtttaacggtcgggggacccgtagggggtacccgtccggtacggttcccgtaccgttccccg

SEQ ID NO: 411752 - DNA, 576 bp, Homo sapiens
  misc_feature: GZ8MTXP02F6XIA.17.28.C06.1.454.CMB.2.raw
  modified_base (373)..(373): a, c, t, g, unknown or other
  modified_base (504)..(504): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggagctggtccagcctgggggtccctgagactctcctgtgcagcctcggattccccttcagtagttatggatgacttggtccgcagactccgagggaaggggctggagtgggtggccaacgataaagcaaagatggaaactgaccccgtagtttacgnggactctgttgagggccgtttcaccatcctcaagacgaacaaacgcccaaagtaattacattacgtacttacctaacaaactagaaacaagtccgtagacgagtcgacgagaccacggccgtagtatacgngtcgagagatagaaggaaaaagtactgactgttagttaagttcggggcgtagggacgtccgtggcctacccg

SEQ ID NO: 411753 - DNA, 595 bp, Homo sapiens
  misc_feature: GZ8MTXP02J45HJ.17.28.C06.1.454.CMB.2.raw
  modified_base (278)..(278): a, c, t, g, unknown or other
  modified_base (404)..(404): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggttgaggtccggggagcctggtccagccgtgggggtccctgagactctcctgtgcagcctccggattccccttnagtagttattggatgacttgggtccgccagactccgaggggaaggggctggagtggggtggaccacaataaagcgaacgagtaggaaacgtcgccccgtaggtttacgtcgtacgtcgtcgttggnggggtacgttaccgtcctacactcacgacgacaacgaccgactaacactactacgtatactactaacacgtacacacgaccgtgacgagacgacacgaccgtacggcgtacggttattagtgacgacgagatagtaaagaagtacgtaagtggtgttgttggttacggtcggtcggcgtccgcggttcccg

SEQ ID NO: 411754 - DNA, 629 bp, Homo sapiens
  misc_feature: GZ8MTXP02HZVO8.17.28.C06.1.454.CMB.2.raw
  modified_base (206)..(206): a, c, t, g, unknown or other
  modified_base (237)..(237): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggnaggagggtcaccatatcttgttctggaaacngctccggcatctcaactaactattttgctggtaccagcaattccccaggactcccggccccccgactccctcatctatagaaaatgatcatccggccccgtccggggtccctgaccccgtattcctctcggctccatcgtctcggcctaccctcacgtccctccctgaccattcaggtcgggcctccggtaccgaggtagtggacggtctaggtactttaattacgtgtcgcgtaccggtgggactgtaactacttccgtaggtaacggttccgggttccggggtcggttccgggggacgggaacgggggaacccgtacggggcccgttacggaaccccggttccgtaaacggtaccgaccggacccgaacggtccgtacccggtccccccg

SEQ ID NO: 411755 - DNA, 680 bp, Homo sapiens
  misc_feature: GZ8MTXP02I6Q15.17.28.C06.1.454.CMB.2.raw
  modified_base (278)..(278): a, c, t, g, unknown or other
  modified_base (393)..(393): a, c, t, g, unknown or other
  modified_base (486)..(486): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgaggtccggggagcctggtccagccgtgggggtccctgagctctcctgtgcagcctccggacttccccttnagtagttattggatgacttgggtccgccagacctccgaggggaaggggctgggaggtggggtggaccaaacaagttaaaaggtaagagtaggaactggtaccgtaggttttacgnggtactcgtggtaggaacgggtccgtttacacctatcctccgagagaacaacgccaaagtacttcacttgtactcctaactaactacgaaacngtaccctaggaacgtacggtccgacgtaacgaccgaaccgggtccgttagttaacgttacgtggtacgacgtaaggtacgttaggtaaagggtaaaaaacgttagtagggtacttagggttacgttttaagggtcgggggtacccgaagggggtacccgtacccggtacggttacccgtaaccccggtttcccg

SEQ ID NO: 411756 - DNA, 560 bp, Homo sapiens
  misc_feature: GZ8MTXP02HE85F.17.28.C06.1.454.CMB.2.raw
  modified_base (302)..(302): a, c, t, g, unknown or other
  modified_base (376)..(376): a, c, t, g, unknown or other
  modified_base (412)..(412): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggttttccttgttgctgttttagaaggtgtccagtgtgaggtcagttggttgagtccggggagcctggtccagccgtgggggtccctgagactctcctgtgcagcctccggattccccttcagtagttattggatgacttgggtccnccagactccgagggaaggggctggagtgggtggcaacataaagcaaagatggaaactgacccgtagttttacgnggactctgtgacgggtccgtttcaccatctccaganacaacgcctaaagaattcaactgtatactacaactgaaacagcctagagagtcgacagaacacggaccgtgtattactgtgactagatggtaagaaaaagtatcggctgtgtttaagtgggaccgagggtacgcccgtggtactaccg

SEQ ID NO: 411757 - DNA, 615 bp, Homo sapiens
  misc_feature: GZ8MTXP02INDUB.17.28.C06.1.454.CMB.2.raw
  modified_base (383)..(383): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggagcctggtccagccgtgggggtccctgagactctcctgtgcagccctccggacttccccttcagttagttattggatgacttgggtcccgcagacctccgagggaggggctggagtgggtggaccaacataaagcaagatggaaactgacccgtagtttacgnggactcgtggtagacggggtcctttcaccgtatcctcgagacgacaacgaccaaagacttcacttagtactactaacaactagaacacgtcctagaagacgtcgacgaagaccgacgggccgttagttaacttacgtgtgacgagtagtaggtaaaggaaaaagtacgtgtacgttgttaggtttaacggttcggggaccgtaggggtacgtcccggttaggtcctacccgg

SEQ ID NO: 411758 - DNA, 618 bp, Homo sapiens
  misc_feature: GZ8MTXP02GZDPB.17.28.C06.1.454.CMB.2.raw
  modified_base (209)..(209): a, c, t, g, unknown or other
  modified_base (240)..(240): a, c, t, g, unknown or other
  modified_base (501)..(501): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtcgtcgggacccccggnaggaggtcaccatatcttgttctaggaaacngcctccggcatctacaaactaaactattttgctggtaccagcaacttcccgaggactccccggcccccgactcctcactctaatagaaatgactcacgtccggccccgtccgggtcctacgaccccgtacttctcgtcgcctcctatcgtctcggccacctcacgtccctccacgaccactcgaggtcggacccgttccgggacgaggtatcggaggtcttagtaatttacgttacgtggtcgaccggtacggtagggtanacgtactacgtaccgtagtacggttcgggttccggtggttaccggggacgggacgggacctacggtcgtacgtaccgtaaccgtaagccgaccgaccgtacgccgtcccgtcccccg

SEQ ID NO: 411759 - DNA, 567 bp, Homo sapiens
  misc_feature: GZ8MTXP02FMEOB.17.28.C06.1.454.CMB.2.raw
  modified_base (301)..(301): a, c, t, g, unknown or other
  modified_base (373)..(373): a, c, t, g, unknown or other
  modified_base (435)..(435): a, c, t, g, unknown or other
  modified_base (483)..(483): a, c, t, g, unknown or other
tcagcgtagactagcacgaccggtgctcgatttagagctcacgtattgggtttggggctcagagaggaggcttagccctggactccaaggcctttccacttggtgatcagcacctgagcacagaggactcaccatggagttggggctgaactgggttttccttgttgctgttttagaaggtgtccagtgtgaggtccagttggttgagtccggggagcctggtccagccgtgggggtccctgagactctcctgtgcagcctccggattccccttcagtagttattggatgacttgggtccnccagactccgaggggaagggctggaggtgggtggccaacataaaagcaagatggaactgccgagttttacgnggactctgtggaagggtccctttcgacctatcctccaagagacaacgcaaagatcactgtanctacaactgaacagcctgagagtcgacagacacggccgtgtattacgngtgcgaagagtggtaaggaaaaagttagtggacttggtagtttacggtggggaccgagggacgtccctgggtcctaccggttcc

SEQ ID NO: 411760 - DNA, 673 bp, Homo sapiens
  misc_feature: GZ8MTXP02JASZ1.17.28.C06.1.454.CMB.2.raw
  modified_base (258)..(258): a, c, t, g, unknown or other
  modified_base (280)..(280): a, c, t, g, unknown or other
  modified_base (309)..(309): a, c, t, g, unknown or other
  modified_base (427)..(427): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgcttgttttagaaggtgtccagtgtgaggtcagttggttgaggtccggggagcctggtccagccgtgggggtccctgagctctcctgtncagccctccggacttccccttnagttagttattggatgacgttgggtcccnccgtaagacctaccggaaggggaacggggctaggggaggttggggtcggacccaaaacgaagtaaaacggacaaaggaagtacgggaaactcggacccccggttaaggtttttaccgnggtaaccttcgtaggtggaacgggggttcctttacaccgtatcctacgagacgaacaaccgaccaaagtacttacatagtatactaacaactagaacacgcctagagtagtcgacaacgaccgaccgggtaccgtattacgttacgtgtacgagaagtagtaggaaaggtaaaaagttagtacggttacgtggtttaggtttaagggttcgggacgtacggggacgtccggtcggtaccgtacccg

SEQ ID NO: 411761 - DNA, 619 bp, Homo sapiens
  misc_feature: GZ8MTXP02I8YKU.17.28.C06.1.454.CMB.2.raw
  modified_base (304)..(304): a, c, t, g, unknown or other
  modified_base (374)..(374): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtccagtgtgaggtccagttggttgagtccggggagcctggtccagccgtgggggtccctgagactctcctgtgcagccctccggattccccttcagtagttattggatgacttgggtccncagactccgagggaaggggctggagtgggtgccaacataaagcaaagatggaactgcccgtagtttacgngactctggtgaggggtcctttacacctatcctaccagacgacaacgaccaaagaacttcacttgtactactaacaactagaacagcctagacgtagtccgacaacgaccacgggccgtagttacttacgtggtcgacgtagtagttaggtaaagggtaaaaaaagttagttagggtactttaggtttaggttttaacgtcgggggtacctacgggggactcccccggttaggtaccctaccccgg

SEQ ID NO: 411762 - DNA, 649 bp, Homo sapiens
  misc_feature: GZ8MTXP02HA831.17.28.C06.1.454.CMB.2.raw
  modified_base (385)..(385): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtcgggggaggcctggtccagccgtgggggtccctgagactctcctgtgcagcctccggtacttccccttcagtagttattggatgacgttgggtccgccagacctccgaggggaggggcgtggaggtggggtgaccaacataaagcaaagagtggaactgccgtagtttacgnggtactgtgagaggggtccttcacctatcctacagaacgacaacgaccaagattacactacgtatacctaacaacttacgaacacgaccttaggaacgtagtaccggacaaggacccgacgggtccgttaggttaacttacggtgtacggacgtaagtaggttagggtaaacggtaaaaaggttacgttagggtacgtttaggtttagggtttaaggtcgggggtacgacgggggtaccgtaccggttcggtaccgtaccccgg

SEQ ID NO: 411763 - DNA, 632 bp, Homo sapiens
  misc_feature: GZ8MTXP02H96TV.17.28.C06.1.454.CMB.2.raw
  modified_base (281)..(281): a, c, t, g, unknown or other
  modified_base (393)..(393): a, c, t, g, unknown or other
  modified_base (480)..(480): a, c, t, g, unknown or other
  modified_base (492)..(492): a, c, t, g, unknown or other
  modified_base (571)..(571): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccaggggaggcctggtccagccgtgggggtccctgagactctcctgtgcagccctcggacttccccttnagtagttatggatgacgttgggtccgccagactccgaggggaaggggctgggaggtggggtcggaccaaacgataaaagcaaagagtaggaactggaccgtagtttttacgnggtacttcgtggtggaaacggggtccctttacacctatcctcagacgacaacgtccaaagtaactcatgtatctaacactagaaacncgacctagtagngtacgacacgaacgacgggtccgttattaacttacgtgtacgacgaagtagtagtaaagggaaaaaagttagtacggtnttaggttaaggttttaacggtacgggggaccgtaaggggaccgtcccggttggtaaccccg

SEQ ID NO: 411764 - DNA, 705 bp, Homo sapiens
  misc_feature: GZ8MTXP02JJ2NK.17.28.C06.1.454.CMB.2.raw
  modified_base (284)..(284): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtgggggtccctgagactctcctgtgcacgccctccggacttccccttnagtagttattggatgtacgttggtccgccagacctccgaggggaacggggctggaggtggggtcggaccaaacgaagtaaaacgacgaaaggagttacggaaacgtcggtaccccggttaagttttacggtaggtaaccttcgtaggtacggacggggtcccgtttacacctactcctaccgaagaacgaaaccaaacgaacccaaagtaacttccgaacgttagtactaaccttaaacaaacgttacgaaaccgaacgtcccgttaaggaacggtacgtaccgaccaaaggaaccgaccgggtccggttagttaacttaccgtgtacgcgtaagtagtaggtaaaaggtaaaaagtagtcggacgttagttagtttaaggtcggggacgacggggtacctcccggtcggtacctacccgg

SEQ ID NO: 411765 - DNA, 587 bp, Homo sapiens
  misc_feature: GZ8MTXP02GK4EO.17.28.C06.1.454.CMB.2.raw
  modified_base (279)..(279): a, c, t, g, unknown or other
  modified_base (374)..(374): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagccgtgggggtccctgagactctcctgtgcagcctccggattcccccttnagtagttatggatgacttggtccgcagactccgagggaaggggctggagtgggtgccaacataaagcaaagatggaactgacccgtagtttacgnggactcgtgaggaggggtccctttcaccctatcctaccagacacaacgaccaagaattcactgtatctaacaactagaaccagcctaggacgagtcgacagaccacggccgtagtacttactgtgcggagtagtaggtaaggaaaaagttatagggtactaggttgtttaagttcgggggacacggggtacgtcccggtacggtcgtaccccg

SEQ ID NO: 411766 - DNA, 598 bp, Homo sapiens
  misc_feature: GZ8MTXP02GR8EK.17.28.C06.1.454.CMB.2.raw
  modified_base (302)..(302): a, c, t, g, unknown or other
  modified_base (383)..(383): a, c, t, g, unknown or other
  modified_base (462)..(462): a, c, t, g, unknown or other
  modified_base (513)..(513): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggtgaggtccggggagcctggtccagccgtggggggtccctgagactctcctgtgcagcctccggacttccccttcagtagttattggatgacttgggtccnccagactccgaggggaaggggctgggagtgggtggaccaaacgataaaagcaaagataggaactggaccgtagttttacgnggactctggtggaagggtccgtttacacccatcctccagacgacaaacgccaaagaactcactgtatactaacaactanaacacgcctagacgagtacgacagaccgtacggccgtagtactacgtgtgngaagacgtaggaaggaaaaagtacgtggtacgtgttggtttaacgttgggggacctaggggacgtcccgtgggtccaccggttcc

SEQ ID NO: 411767 - DNA, 700 bp, Homo sapiens
  misc_feature: GZ8MTXP02HNES9.17.28.C06.1.454.CMB.2.raw
  modified_base (209)..(209): a, c, t, g, unknown or other
  modified_base (240)..(240): a, c, t, g, unknown or other
  modified_base (264)..(264): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcacgcccaccctcagtgtcgtcgggaccccggnaggaggtcaccatatcttgttctaggaaacngcctccggcatctacaactaactntttgctaggtaccagactaacttcccgaggacctccccggccccctactcctactactactaataagaaatgatacacgtcccggccccgtccggggtccctagaccccgtacttccgtcgtcggcctccgagttccgtcgtcggaccctacccgtacacccgtccctcccgtacgaccctacgtaccggacgggtccgggtaccccgttcccggggtaccgtaagggtacgttacgggacggttacgtttaggtaaacttttacgttacgttaggtaccgtaccgggtaccgggtagggtacttacggaaccttcggtaccgtaggtacggttcggggttccggtgggttaccggggacgggtacggaaccgacggtccgtacggtaccgtaacgtaacgccgacggacccgtacgtccggggtccctaccccgg

SEQ ID NO: 411768 - DNA, 619 bp, Homo sapiens
  misc_feature: GZ8MTXP02JJ2UQ.17.28.C06.1.454.CMB.2.raw
  modified_base (384)..(384): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtcagtgtgaggtcagttgtgagtcggggagctggtcagccgtgggggtcctgagactctcctgtgcagcctccggacttccccttcagtagttattggatgacttgggtcccgcagacctccgaggggaaggggctgggaggtggggtcggaccaaacgataaaagcaaagagtaggaaactgaccccgtagttttacgngtactcgtggtaggacgggtcctttcaccgtatcctaccagacgaacaaccgacaagaacttcactagtactactaacaactagaacagaccgtagaacgagtccgacgaacgacgacggtccgtgtaacttacgtgtgacgtagtagtaggtaaaggtaaaaatacgttggacgtttaggttaggtttaaggtcggggacgtacggggacgtcccgtacgggtaccgtacccgg

SEQ ID NO: 411769 - DNA, 630 bp, Homo sapiens
  misc_feature: GZ8MTXP02HFAHS.17.28.C06.1.454.CMB.2.raw
  modified_base (189)..(189): a, c, t, g, unknown or other
  modified_base (209)..(209): a, c, t, g, unknown or other
  modified_base (239)..(239): a, c, t, g, unknown or other
  modified_base (263)..(263): a, c, t, g, unknown or other
  modified_base (465)..(465): a, c, t, g, unknown or other
  modified_base (517)..(517): a, c, t, g, unknown or other
  modified_base (522)..(522): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcacgcccaccctnagtgtcgtcgggaccccggnaggaggtcaccatatcttgttcaggaaacncgctcggcatctacaactaaactnttttgctacggtaccagactaacttccccgaaggaccgtccccggacccccctaatccctcattctaataagaaatgaactcacgtcccggcccgtcccggggtaccctggacccccgtattccgtcgtcgactcctagtcggtctcggaccctaccctcgaccgtcccttcccacgaccctaattccgagggggggtcccnccgttcccggtcgaagtcgtgagtctagtaatttagcgttgcgacgtacggnggtanacgtactacgtcgtaagtcgggtttcggacggttggccgggacggaacggaccggtgtaccacgggtacctaacgaaggccaaccgccgacgtcccttcccgaccccg

SEQ ID NO: 411770 - DNA, 628 bp, Homo sapiens
  misc_feature: GZ8MTXP02II423.17.28.C06.1.454.CMB.2.raw
  modified_base (223)..(223): a, c, t, g, unknown or other
  modified_base (383)..(383): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagccnggtccagcctgggggtcctgagactctcctgtgcagcctccggattccccttcagtagttattggatgacttgggtccgccagacctccgaggggaaggggctggaggtggggtggaccaacaataaaagcaaagatggaaactgacccgtagtttacgnggactcgtgtgacgggtccgtttacacctatcctcaagacgacaacgacaaagaatcaactgtactctaacaactagaacagacccttagagtacgtcgacgagaacgacggtaccgttagtacttacgtgtgacgtaaggtagttaggtaaggtaaaaaaaggtagttacgggacttaggttaggtttaaacggttcgggggaacccgtagggggacgtccccggttaggtacccgtaacccgg

SEQ ID NO: 411771 - DNA, 644 bp, Homo sapiens
  misc_feature: GZ8MTXP02F0B7R.17.28.C06.1.454.CMB.2.raw
  modified_base (498)..(498): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgtttagaaggtgtccagtgtgaggtccagttggtgaggtccggggagctggtccagccgtgggggtccctgagactctcctgtgcagcctccggacttccccttcagtagttatggatgacttggtccgcagactcgagggagggctggagtgggtaggacaaacagtaaagacgaaagataggaaactggacccgtagttttacgtggtacttcgtaggtagggtacgggggtccctttcgacctactcctaccgaagaacgtaaccaacgacccaaagtaacttaccactgtactactaacaactagaaacacgcctagaacgngtacgcgaagaccgacgggtccgttagtaacttacgtgttcgacggaagtagttaggtaaagggtaaaaattaggtaggtacgttggtttaaggtttaaggtttcgggggacgtaacgggggacgtcccggtcggtactaccccgg

SEQ ID NO: 411772 - DNA, 605 bp, Homo sapiens
  misc_feature: GZ8MTXP02JLR9H.17.28.C06.1.454.CMB.2.raw
  modified_base (302)..(302): a, c, t, g, unknown or other
  modified_base (379)..(379): a, c, t, g, unknown or other
  modified_base (525)..(525): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagcctggtccagccgtgggggtccctgagactctcctgtgcacgcccccggattcccctcagtagttatggatgacgttggtccnccagactccgaggggaagggctgggaggtgggtggaccaacataaaagcaagataggaactgaccgtagttttacgnggtactcgtgtgaacgggtccgtttacacctatcctccaagacgacaaaccgaccaaagtaacttcgacttagtactacctaacaactagaaaccagaccgtgaagacgtccgacgaacgaccgtaccggccgtagttacttacgngtgacgagtataggtaaggaaaaacgtgtaggtctagttagtttaggtcgggacgaagggcgcctggtccaccgttcccg

SEQ ID NO: 411773 - DNA, 660 bp, Homo sapiens
  misc_feature: GZ8MTXP02JMSZA.17.28.C06.1.454.CMB.2.raw
  modified_base (278)..(278): a, c, t, g, unknown or other
  modified_base (392)..(392): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagcctggtccagccgtgggggtccctgagactctcctgtgcagcctccggacttccccttnagttagttattggatgacgttgggtccgcagactccgaggggaaggggcgtggaggtgggtcggaccaaacagtaaaagcgaaagagtaggaaactgaccccgtagttttacgnggtactcgtgtaggacgggtcctttacaccgtatcctaccgagacgaaccaacgacaaagtaacttcaacgttgtactactaaccaacgtacgaaacacgtacctaggaacgacgtacgacgaacgaccgaccgggtaccgttagtaacttaccgtgtcgacgtaagtagttaagggtaaaacggtaaaaagttagttcggtacgtttggttaggttttaagggcggggaccgtaggggaccgtacccggttcgggtacctaccccgg

SEQ ID NO: 411774 - DNA, 669 bp, Homo sapiens
  misc_feature: GZ8MTXP02HGAFX.17.28.C06.1.454.CMB.2.raw
  modified_base (210)..(210): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagcccaccctcagtgtcgtcggggacccccgggnaggagggtcaccatatcttgttctaggaaacagctccggcatctacaaactaaactattttgctaggtaccagacaactcccaggactcccggccccccactcctcatctataagaaatgatcacgtccggccccgttcccggggtccctacggtaccgtactttcctcgtcggctcctatcgtctcggctaccctcgaccgtccctcccctcgaccctagtccgacggtcgggcccgttcccgggtcggacggtagtcggaggtctagtatttaacgttaccgttgtacgtaccgtaccgggtagggtacttacggaactacgtccgtaggttaacggttcggggttacccgggttcgggttaccggggacggggtaacgggtaccgcgggtaccgtaccggtacccgttacgtaaccggcgaaccggacccgtaccggccgtcccggtccccgtcgg

SEQ ID NO: 411775 - DNA, 717 bp, Homo sapiens
  misc_feature: GZ8MTXP02HNGS8.17.28.C06.1.454.CMB.2.raw
  modified_base (298)..(298): a, c, t, g, unknown or other
  modified_base (375)..(375): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgctgctgtttagaggtgtccagtgtgaggtccagttggttgagtcggggagctgtcagccgtgggggtcctgagactctcctgtagcacgcctcggacttcccctcagttagttatggatgacttgggtccncagactccgaggggagggctggagtgggtggaccaataataaagcaaagagtaggaactcgacccgtagttttacgnggtacttcgtggtcgggtaaacggggtcccgtttaccaccgtattacctaccgagaacgaacccaaacggcccaaaaggaacttttcaacgttagtaacttctaaactaaacctaggaaaacctacgtaccgttaggaacggacggtaccggacaacggaccgaccggggtaccgttaaggtttacgtttaaccgtggttaggacggtaagtagttaagggtaaaacggtaaaaaaggttacgttacggggttactttaggggtttaaggggtttttaacggtaccggggggttaccgaaacgggggtacccggttccccggtttaacgggggtttcccccg

SEQ ID NO: 411776 - DNA, 640 bp, Homo sapiens
  misc_feature: GZ8MTXP02IUEHL.17.28.C06.1.454.CMB.2.raw
  modified_base (300)..(300): a, c, t, g, unknown or other
  modified_base (318)..(318): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtcggggagcctggtcagccgtgggggtcctgagactctcctgtgcagcctccggattcccctcagtagttattggatgacttggtccncagactcgagggagggcnggagtggtgaccaacataaagcaaagataggaactgacccgtagtttacgtgactcgtgtagacgggtccgtttacacctatcctacagagacaacgaccaagaattcactgtactactaacaaactagaacagacctgaaggagtaccgacaacgaccgaccggtccggtagttaacgttaccgttgtcgacggaagtagttaagggtaaaggtaaaaaaacggttaaacgtagggtccgtttaggttaggttttaacgggtttcgggggacccgtaaacggggggtactcccccggtttaggggtaccccgttaacccgg

SEQ ID NO: 411777 - DNA, 587 bp, Homo sapiens
  misc_feature: GZ8MTXP02GXKKG.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtggggggtccctgagactctcctgtgcagcctccggattccccttcagtagttattggatgacttgggtccgccagactccgaggggaaggggctggagtggggtggccaaacataaagcaaagatggaactgcccgtagtttacgtggactctgtgaggggtcctttcaccgatctccagagacaacgccaaagaacttcactgtactctaacaactagaacagcctagagagtcgacgagacgaccggcgtagtacttacgtgtgcgtagataggtaaggaaaaagtagtggacttggttaggtttaaggttggggacccgaggggacgtcccgtacggtccgtacccg

SEQ ID NO: 411778 - DNA, 662 bp, Homo sapiens
  misc_feature: GZ8MTXP02IKEEX.17.28.C06.1.454.CMB.2.raw
  modified_base (497)..(497): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgcttgttttagaaggtgtccagtgtgaggtccagttggttgaggtccggggagctggtccagccgtgggggtccctgagactctcctgtgcagccctccggtacttccccttcagttagttattggatgtacgttgggtccgccagactccgaggggaaggggcgtagggaggtggggtcggaccaaacaataaaagcaaagagtacgggaaactggaccgtagtttttacggcgtacttcgtggtacggaacgggtcccgtttacacgtatcctccgagacgaacaacgacaaacgtaattcacttagtactcttaaacaactacgaaacncgacctaggaacgagtaccgacacggaaccgtaccggtaccgttaggttattacgtgtagacggaagtacgtagggtaaaggaaaacgttaagtggtacgttaggtttagtttaggtcggggtaccggtaagggtaccggtcccgttcggtacctaccggttccc

SEQ ID NO: 411779 - DNA, 578 bp, Homo sapiens
  misc_feature: GZ8MTXP02IGL6B.17.28.C06.1.454.CMB.2.raw
  modified_base (374)..(374): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggttgagtcggggagctggtcagcctgggggtccctgagactctcctgtgcagccctccggattccccttcagtagttattgatgacttgggtccgccagacctccgaggggaggggctggagtgggtggaccaacaataaaacaagataggaactgccgtagttttacgnggtactcgtgtggaagggtcccgtttcactatctccgagagacaacgccaaagtaacttcactgtatctaacaactgaacagcctagacgagtcgcaggacctacggccgttagtacttacgtgtcgacgagagtaggtaaggaaaaatagacggtcgtagttgtttaagtcggggacgagggtacgccgtcggtcacgttccc

SEQ ID NO: 411780 - DNA, 573 bp, Homo sapiens
  misc_feature: GZ8MTXP02GB2VQ.17.28.C06.1.454.CMB.2.raw
  modified_base (382)..(382): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtggggggtccctgagactctcctgtgcagccctccggattccccttcagtagttatggatgacttgggtccgccagactccgagggaaggggctggagtggggtgccaacataaagcaaagatggaaactgccccgtagttttacgnggactctgtgaggggtcctttcaccatcctcagacgacaacgccaaagaattcactgtatctaacaactagaacagcctagagagtcgacagacacggccgtgtattactgtgacgagatggtaaggaaaaatagtggacttggttagtttaaggttcggggaccgaggggacgtcccgtgggtctacccg

SEQ ID NO: 411781 - DNA, 608 bp, Homo sapiens
  misc_feature: GZ8MTXP02HUXVY.17.28.C06.1.454.CMB.2.raw
  modified_base (278)..(278): a, c, t, g, unknown or other
  modified_base (375)..(375): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtcagccgtgggggtccctgagactctcctgtgcagcctccggattccccttnagttagttattggatgacttggtccgccagactccgagggaggggctggaggtgggtggccaacataaagcaagatggaactgcccgtagtttacgngtactctgtgacgggtcctttacacctactcctccagacgaaccaaacgacccaaagtaacttcacttgtaacttactaacaacttacgaacacgcctggaagtacgtcgacgacgaccgacggtccgttatacgttactgtgcgagtagttaggtaaagaaaaagttagtcggtacttggtttagtttaaggttcgggggaccgtaggggacgtcccgtaggttcctacccg

SEQ ID NO: 411782 - DNA, 621 bp, Homo sapiens
  misc_feature: GZ8MTXP02IME7N.17.28.C06.1.454.CMB.2.raw
  modified_base (383)..(383): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggagctggtccagccgtgggggtccctgagactctcctgtgcagcctccggacttcccctcagtagttattggatgacttgggtcccgccagacctccgagggaaggggcgtggagtggggtgccaacaataaagcaaagataggaactggcccgtagttttacgngactctggtagaggggtccgtttcacctatcctacagacaacgacgaccaaagtacttcactagtactactacaactagaacagacctagaacgtagtcgacgaacgaccgaccgggaccgttggttaacttacgtgtagacggtaagtagttaggtaaacgggaaaaaagttaacgtggtacttggttagtttaaggttacggggacgacggggacgtccgttcggtaccgtacccg

SEQ ID NO: 411783 - DNA, 590 bp, Homo sapiens
  misc_feature: GZ8MTXP02HCL4B.17.28.C06.1.454.CMB.2.raw
  modified_base (263)..(263): a, c, t, g, unknown or other
  modified_base (291)..(291): a, c, t, g, unknown or other
  modified_base (370)..(370): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttctgtgctgttttagagtgtcagtgtgagtcagtggttgagtcggggagctggtcagccgtgggggtcctgagactctctgtgcagcctccggattcccctnagtagttattggatgtacgttgggtccnccagactccgaggggaggggctggagtgggtggaccaaacagtaaaagcaaagatggaaactgccccgtagttttacgngtactcgtgtaggacggggtccgtttacacctatcctaccagacgaacaacgaccaagaacttcactgtactctaacaactgaacaggcctagagtagtcgacagaccgacggtcgtagtaacttagtgtagcgaagtagtacggtaaaggaaaaagtacgtggtcttaggttagttaaggttcggggacctaggggacgtccgttcgggtacctacccg

SEQ ID NO: 411784 - DNA, 662 bp, Homo sapiens
  misc_feature: GZ8MTXP02HTZ1P.17.28.C06.1.454.CMB.2.raw
  modified_base (234)..(234): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggaccccggcagaggtcaccatatcttgtcaggaacngctccgcatctacaactaaactattttgcgtcggtaccagacctaacttcccgagtacctccccggcccccgacctccctcactactaataagaaaatgtactcgactcccggccccgttccccggggtcctacgaccccgtacttcctcgtcggtcctacgtacgtcgtccgtcggccctacccgtcaccgtcccttcccacgaccctactcgtacggtcgggcccgtccggtaccggaggacgtcgggtacgtcgttaagtatttaacgttacgttggtcgaccggtaccggttaggggactaggacctacgtaccgtagtaaacggtcgggttcgggtcgggttacgggcggggaacggaccgtacggtccgtcgtaacccgtcgtaacgaccgacgacccgaaccggtccgtaccgtcccccgg

SEQ ID NO: 411785 - DNA, 666 bp, Homo sapiens
  misc_feature: GZ8MTXP02GEBBJ.17.28.C06.1.454.CMB.2.raw
  modified_base (398)..(398): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgcttgttttagaaggtgtccagtgtgaggtccagttggttgaggtccggggagctggtccagccgtgggggtccctgagctctcctgtgcagccctccggacttccccttcagtagttattggatggacttgggtccgccagacctccgaggggaaggggctgggaggtggggtggaccaaacgaataaaagcaaagagtaggaaactggaccccgtagtttttacggnggaccttcgtggtaggacgggggtcctttacgaacctattccgtaccaaggaacgaaccgaaaccgacccaaagtaacttcaacttagtacttactaacaactacgaaacacgcctaggacgagtccgacgaagaaccgacgggccgttagtaacttacgtgtagacggtaagtagtaggtaaaggtaaaaagtacgtaggtacgttaggtttagtttaagggttcgggggtaccgtaagggggtaccgtcccgttagggtaccaacg

SEQ ID NO: 411786 - DNA, 639 bp, Homo sapiens
  misc_feature: GZ8MTXP02IPP99.17.28.C06.1.454.CMB.2.raw
  modified_base (346)..(346): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggaggcctggtccagctgggggtccctgagactctcctgtgcagccctccggattcccccttcagtagttattggatgacttggtccgccagacctccgaggggaaggggctggaggtggggtggaccaanataaaagcaaagatggaaactgaccccgtagtttacgtggactctgtgacgggtctttacgaccatcctcagagaacaacgaccaaagaactctactagtactactaacaactagaacagacctgaagtagtcgacgaccgacgtaccgggacccgttgtaactttaacgtggtcgacggtaagagtagggtaaacggtaaaaaaaggttagtaggtacgttagtttaggttttaaaggtcggggtaccggtacgggggtaaccgtcccggttacgggtacccgttaccccgg

SEQ ID NO: 411787 - DNA, 559 bp, Homo sapiens
  misc_feature: GZ8MTXP02JNWQ1.17.28.C06.1.454.CMB.2.raw
  modified_base (260)..(260): a, c, t, g, unknown or other
  modified_base (306)..(306): a, c, t, g, unknown or other
  modified_base (336)..(336): a, c, t, g, unknown or other
  modified_base (381)..(381): a, c, t, g, unknown or other
  modified_base (473)..(473): a, c, t, g, unknown or other
  modified_base (494)..(494): a, c, t, g, unknown or other
  modified_base (545)..(545): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggagcctggtccagccgtgggggtccctgagactctcctgtncagcctccggacttccccttcagtagttattggatgacttgggccnccagactccgagggaggggctggagtgggngccaacgataaagcaaagatggaaactgaccccgtagttttacgngactctgtgaggggtccgtttcaccatctccagacgacaacgacccaagattcactgtaatctaacaactagaacacgcctagagagtcganagtacacggtcgtgtattacngtagcgagatggaagaaaagtagtgctgtgttaagtggggaccgtagggcncccgtggtctaccg

SEQ ID NO: 411788 - DNA, 602 bp, Homo sapiens
  misc_feature: GZ8MTXP02G0JBR.17.28.C06.1.454.CMB.2.raw
  modified_base (302)..(302): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagctggtcagccgtgggggtccctgagactctcctgtgcagcctccggattccccttcagttagttattgatgtacgttggtcccncagactccgaggggaaggggctggggagtgggtcggaccaaacaagtaaaagcaaagagtaggaactggccccgtagtttacgtggacttcgtggtggacggggtcctttacacccgtattcccacgagaacacaaaccgtccaaaagtaacttcaacttgtacttactaacaactagaactagccttaggacgagtcgagacgacgacggcgtgtaattactggtgacgaggataggtaaagaaaagtagtgacttggttgttaaggtgggaccaggggacctccgtcggtctacccgg

SEQ ID NO: 411789 - DNA, 634 bp, Homo sapiens
  misc_feature: GZ8MTXP02H1KT8.17.28.C06.1.454.CMB.2.raw
  modified_base (397)..(397): a, c, t, g, unknown or other
  modified_base (541)..(541): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtccagtgtgaggtccagttggttgagtccggggagcctggtccagccgtgggggtccctgagactctcctgtgcagcctccggacttcccctcagtagttattggatgacttgggtccgccagacctccgaggggaaggggctaggaggtggggtcggaccaaacaagtaaaagcaaaggaagtaggaaactggaccccgtagtttttacggnggtacttcgttggttacgacgggggtcccttttacacccgtattcctccgaagtacgaccaaacgccaaagattacacttagtatctaacaactagaaacacgcctagacgtagtcgacgagacgacggccgttagtattacgngtcgacgagagtaggtaagaaaaaggttagtaggtcttaggttagttttaaggcgggggtaccgtaggggcgtacccgttggtaccctacccg

SEQ ID NO: 411790 - DNA, 632 bp, Homo sapiens
  misc_feature: GZ8MTXP02HXYGM.17.28.C06.1.454.CMB.2.raw
  modified_base (310)..(310): a, c, t, g, unknown or other
  modified_base (473)..(473): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggttgaggtccggggaggcctggtccagccgtgggggtccctgagactctcctgtgcagcctccggtacttccccttcagtagttagttggatgtacgttgggtccnccagacctccgaaggggaaggggctggaggtgggtgaccaacaataaagcaagatggaactgccccgtagtttacgtgactcgtggtaggacgggttccgtttacacctatcctaccgaagaacgaaccaaaccggaccaaaagtaacttccacttagtaacnctaaacaacctgaaacagcctagagagtcgacgaacgacgaccggccgttagtagttacctggtacgcggtaagtagttaggaaaaggtaaaaagtagtacggtcttaggttgtttaagtcgggggacgtaggggacgtcccgtagggtaccctacccg

SEQ ID NO: 411791 - DNA, 638 bp, Homo sapiens
  misc_feature: GZ8MTXP02GF97X.17.28.C06.1.454.CMB.2.raw
  modified_base (279)..(279): a, c, t, g, unknown or other
  modified_base (304)..(304): a, c, t, g, unknown or other
  modified_base (388)..(388): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagccgtgggggtccctgagactctcctgtgcagcctccggattccccttnagtagttatggatgacttgggtccnccagacctcgaggggaaggggctggaggtgggtggaccaaacgaagtaaagcgaaagataggaactggccccgtagttttacgnggactcgtgtagacgggtccttacacctatcctaccaagacgaacaaaccgaccaaagtaaattcacgttagtaactactaacaactacgaaacacgcctaggagacgtcgacgagaccgacgggtccgttagtacttacgtggtacgacggaagagttaggtaaaggaaaaaagttagtacggtacgttgtttaggttggttacgggggaccgtaggggtaccgtacccgttcgggtcccttaacccgg

SEQ ID NO: 411792 - DNA, 576 bp, Homo sapiens
  misc_feature: GZ8MTXP02FJ2AF.17.28.C06.1.454.CMB.2.raw
  modified_base (206)..(206): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggnagagggtcaccatatcttgttctggaaacagctccggcatctcaaactaaaactattttgctggtaccagcaaattccccaggactccggccccccgactccctcatctaatagaaaatgaatcatccggcccccttccggggtccctgaccgacttcctctggcctccattgtctggcacctcacgccctccctgaccctatccaggtcgggcctcccgggtccgaggatgaggctgtattacttactgtgacaccggtgggatgacagtcctagaatgggtcccggtgttcgggcggacggggacccagggcctacggacccgttaccgtaagtccgaacgccccgaaggcctccgcccccgttccgg

SEQ ID NO: 411793 - DNA, 589 bp, Homo sapiens
  misc_feature: GZ8MTXP02JHP30.17.28.C06.1.454.CMB.2.raw
  modified_base (269)..(269): a, c, t, g, unknown or other
  modified_base (292)..(292): a, c, t, g, unknown or other
  modified_base (366)..(366): a, c, t, g, unknown or other
  modified_base (442)..(442): a, c, t, g, unknown or other
  modified_base (463)..(463): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtcagttggtgagtcggggagcctggtccagccgtgggggtcctgagactctcctgtgcagcctcggacttcccctnagtattatggatgacttggtccncagactccgaggggaagggctggagtgggtgccaaacataaaagcaaagataggaactgccgtaggttttacgnggactcgtgtggaagggtccgtttcacctatcctccagacgacaacgccaaagaacttcactgtatcctacaactnaacagcctaggagagtccganaggacgaccggccgtagtattacgtgacgtacgagagtaggtaaaggaaaaacgttagtaggtcttagttggtttaacgtgggggacctaaagggggcgtacccgttggtacccgtacgtttcccg

SEQ ID NO: 411794 - DNA, 585 bp, Homo sapiens
  misc_feature: GZ8MTXP02G2RTZ.17.28.C06.1.454.CMB.2.raw
  modified_base (305)..(305): a, c, t, g, unknown or other
  modified_base (380)..(380): a, c, t, g, unknown or other
  modified_base (508)..(508): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagccgtgggggtccctgagactctcctgtgcagcctccggattccccttcagtagttattggatgacttgggtccncagactccgaggggaaggggctggagtgggtggccaaacataaagcaagataggaactgccccgtagttttacgnggactcgtgtgacggggtcctttcacctatcctccagacacaacgaccaaagaattcactgtatctaacaactagaacagcctaggagtagtcgacgaagaccgacggccgtagtacttacgtgtagngaagagtagtaaacggaaaaagtagtacggcttggttagttaaggtgggaccgtagggacgtccgtggtactacccg

SEQ ID NO: 411795 - DNA, 729 bp, Homo sapiens
  misc_feature: GZ8MTXP02HDQ4I.17.28.C06.1.454.CMB.2.raw
  modified_base (206)..(206): a, c, t, g, unknown or other
  modified_base (235)..(235): a, c, t, g, unknown or other
  modified_base (257)..(257): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggnagagggtcaccatatcttgtctggaaacngctcgcatctacaaactaactntttgctacggtaccagactaactccgagaccgtccccggcccccgtactcctactactactaataagaatgactcgacgtccggtccccgtccgggtcctacgtaccgtaccttccgtcgtcgtcctacgtagttcgtccgtcggaccctacccgtaccgtaccgtcccctacccgtacgtaaccctacgttaccggtacgggttccggggtacccggttacccggggtaccggagggtacgtacggggtacgtcgttagttaacttttaacgttacgttcggttacgaccggtaccggggtacggacgtacgtaacctacgttccgtaggtaacgggttcgggttaccggggttcgggtaccggggacggggtaccgggacggtacggtaccgttaccgggtacccgttaaccgtaacggtacccgaaccggtaccccggtaacggtccccgttacccggtacccccgtgg

SEQ ID NO: 411796 - DNA, 531 bp, Homo sapiens
  misc_feature: GZ8MTXP02HXG9K.17.28.C06.1.454.CMB.2.raw
  modified_base (237)..(237): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggcagagggtcaccatatcttgttctggaaacngctccggcatctcaactaaactattttgctggtacagcaatcccaggatccggccccccgactcctcatctaatagaaatgatcatccggcccctccggggtcccctgaccgacttctctggctccgatcgtctggcaccgtcacgccctcctcgaccatcagtggcctccggtccgaggatgagctgaattgttactgttcgcaccggtggactgactagtcctgaagtcggtcggtcgtacgggcgaggccgagctcgacctcgaacgtcacgacccaggcctcgcccctcg

SEQ ID NO: 411797 - DNA, 559 bp, Homo sapiens
  misc_feature: GZ8MTXP02GW2UJ.17.28.C06.1.454.CMB.2.raw
  modified_base (274)..(274): a, c, t, g, unknown or other
  modified_base (328)..(328): a, c, t, g, unknown or other
  modified_base (334)..(334): a, c, t, g, unknown or other
  modified_base (369)..(369): a, c, t, g, unknown or other
  modified_base (403)..(403): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgttgcttgtttagaaggtgtcagtgtgaggtccagttggtgagtcggggagctggtccagccgtgggggtccctgagactctcctgtgcagcctccggacttccccttnagtagttatggatgacgttggtccgccagactccgagggagggctggagtgggngacaanataaagcaaagataggaactgcccgtagtttacgnggactcgtgtgagggtccttacacatctacaganacaacgacaaagaatcactagtactactaacatagaacagcctagagtagcggactagacgaggccgtagtatacgtgtcgagatagtaggtaaaggaaaaagtagtaggctagttgttaagtcggggacgacgggagtcccgtcggtactacccg

SEQ ID NO: 411798 - DNA, 669 bp, Homo sapiens
  misc_feature: GZ8MTXP02FKEYN.17.28.C06.1.454.CMB.2.raw
  modified_base (209)..(209): a, c, t, g, unknown or other
  modified_base (449)..(449): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtctcggggacccccggnagagggtcaccatatcttgttctaggaaacagcctccggcatctcaaactaactattttgctggtaccagcaacttcccaggactccggccccccatcctcatctatagaaatgatcagtccggcccctccggggtcccctggacccccgtattcctcgtcggtcctcccgattcgtcgtcggacctaccctcacgtcccctccctacgacctatccgaggtcggcccgtccggtaccgnggtactggacgcttaggtatttaacttcgtgttcggaccgtaccggtgggtactaggaacctacgtacccgtaggtaaaggttcggggttccgggtttacggttccgggggacggggaaacggggaccccgtaggggtccgtaccgggttaacccggtaacccgttaaagggtcccaccggtaaccccgaaacgggtcccttacccgggtacccccccgg

SEQ ID NO: 411799 - DNA, 680 bp, Homo sapiens
  misc_feature: GZ8MTXP02I717L.17.28.C06.1.454.CMB.2.raw
  modified_base (207)..(207): a, c, t, g, unknown or other
  modified_base (236)..(236): a, c, t, g, unknown or other
  modified_base (256)..(256): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggnaggaggtcaccatatcttgtctggaaacngctcgcatcacaactaactntttgctagacagactactccgagtacctccccgccccctactcctctactactaataagtaaatgtactcgacgtcccggtccccgtccgggtcctacgtaccccgtcttcgtcgtcgtcctccgtagtcgtcgtcgacctaccctcacccgtccctcccgtacgtacctacgtcgacgggttcccggtcccgttacccgggtaccggaaggtacgtacggacgtacgttagttactttacgttacgttcggtaccgtaccggtacggtaggtacgtacgacgtacgttcggtaaggtacggttcggggttaccggggttacggggttacgggggacggtaacgggaccggtacggtaccgtaccggtacccgtaacgtaaccgtacgtacccggaccggtaccggtcccgtaccccgtccccg

SEQ ID NO: 411800 - DNA, 605 bp, Homo sapiens
  misc_feature: GZ8MTXP02GF6NN.17.28.C06.1.454.CMB.2.raw
  modified_base (280)..(280): a, c, t, g, unknown or other
  modified_base (305)..(305): a, c, t, g, unknown or other
  modified_base (352)..(352): a, c, t, g, unknown or other
  modified_base (375)..(375): a, c, t, g, unknown or other
  modified_base (464)..(464): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtgggggtccctgagactctcctgtgcagcctccggattccccttnagtagttatggatgacttgggtccncagactccgagggaggggctggaggtggtgccaacataaagcaaagntggaactgccccgtagtttacgnggactctgtggaggggtcctttcacctatcctaccgagacgacaacgaccaagattacactgtactactacaactagaacagcctgagngtcgcgagaccgacggccgtagtacttacgtgtggacgagtagttaggtaaaggtaaaaagtagttaggacgttaggtttaggttttaaggttcgggggacccgtagggggtacgtcccggttcggtacccgtaaccccgg

SEQ ID NO: 411801 - DNA, 612 bp, Homo sapiens
  misc_feature: GZ8MTXP02GMAKD.17.28.C06.1.454.CMB.2.raw
  modified_base (397)..(397): a, c, t, g, unknown or other
  modified_base (593)..(593): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggttgagtccggggagctggtccagcctgggggtcctgagactctcctgtgcagcctccggacttccccttcagtagttattggatgacttgggtcccgccagactccgaaggggaaggggctgggaggtggggtcggacccaaacaagtaaaacgcaaaaggataggaaactggaccccggtagtttttacgnggtactcgtaggtagacggggtcctttcaccgtatcctaccagacgaacaacgaccaaagaacttcacttagtactctaacaactagaactacgcctagagagtcacgagaccgtacgccgtgtacttactgtgcgtagataggtaagaaaaggttagtggtacttggttagttaagttcggggacgaggggaccnccggtcggtacctacccgg

SEQ ID NO: 411802 - DNA, 715 bp, Homo sapiens
  misc_feature: GZ8MTXP02GUDGC.17.28.C06.1.454.CMB.2.raw
  modified_base (350)..(350): a, c, t, g, unknown or other
tcagcgtagactagcacgaccggtgctcgatttagagctcacgtattggggtttgggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtgggggtccctgagactctcctgtgcagccctccggtacttccccttcagtagttattggatgacgttgggtcccgccagacctccgaggggaaggggctgggaggtggggnggaccaaacaataaagacaaagagtaggaactggaccccgtagttttacgtagacgtcgtagttacggacggggtcctttaccgacctacgtcctcccgaaagacgaacccaaacgacctaaaacgtaactttaccaacgttagttaacctactaaactaaacgtacgaaaacagacccgttagaacgtaggaccgacgaacgaaccgtacggacccggttaggtaacttaccgttaggtcgacgtaagggtacgtaagggtaaacgggttaaaaagaagttacgggtccgtttggtttaggtttaacgggttcgggggaccggtacgggggtaccgtccccggtacgggttaccctacccccgg

SEQ ID NO: 411803 - DNA, 597 bp, Homo sapiens
  misc_feature: GZ8MTXP02GNY7R.17.28.C06.1.454.CMB.2.raw
  modified_base (278)..(278): a, c, t, g, unknown or other
  modified_base (382)..(382): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggacttccccttnagtagttatggatgacttgggtcccgccagactccgaggggaaggggctggaggtggggtgaccaacataaagcaaagatggaaactgaccccgtagtttacgngactctggtgacggggtcgtttcactatcctccagacacaaacgaccaaagaacttacacttagtatctaacaactagaacgagcctagagagtcgacacgaccacggctagtattacgtgtgcgaagtagtagtaaaggtaaaaagtagtacggtacttaggttagtttaaggttcggggaccgaggggtacgtcccggtaggtcccgtacccg

SEQ ID NO: 411804 - DNA, 561 bp, Homo sapiens
  misc_feature: GZ8MTXP02JDSWD.17.28.C06.1.454.CMB.2.raw
  modified_base (295)..(295): a, c, t, g, unknown or other
  modified_base (329)..(329): a, c, t, g, unknown or other
  modified_base (361)..(361): a, c, t, g, unknown or other
  modified_base (383)..(383): a, c, t, g, unknown or other
  modified_base (433)..(433): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttcctgttgctgttttagaaggtgtccagtgtgagtccagttggttgagtcggggagcctggtccagccgtgggggtccctgagactctcctgtgcagcctcggacttccccttcagtagttatggatgacttggtccncagactccgagggagggctggagtgggtgccaanataaagcaagatgaactgccgtagttttacgngactctgtgagggtccgtttanacctatctccagagacaacgcaaagatcactgtatctacgaactgaaacnacctagagagtcgacacgacacggccgtagtattacgtgtgcgagatggtaaggaaaaagtatcggtcttaggtgttttaacggtgggggactacggggacgcccggtaggtccgtaaccggttcccg

SEQ ID NO: 411805 - DNA, 636 bp, Homo sapiens
  misc_feature: GZ8MTXP02F3KDY.17.28.C06.1.454.CMB.2.raw
  modified_base (207)..(207): a, c, t, g, unknown or other
  modified_base (237)..(237): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggnagagggtcaccatatcttgttctggaaacngctccggcatctcaactaaactattttgctggtaccagcaattcccaggactccggcccccgactcctcatctatagaaatgatcagtccggccccgtccggggtccctcgaccccgtattcctctcggcctccatcgtctcggccaccgtccacgtcccctccctcgaccctactccgaggttcggggcccgttcccgggtccggaggtagtcgggacgtcttagttatttacgtttacgtggttacgcgtacccggtgggtacttacggactacgtccgttaggaacgttcgggttccgggttggtttccgggggacgggtacggggacccgagggtccgtacggtaacccgtccgttaaacgcgacggacccgaacggtccctccggtccccccgg

SEQ ID NO: 411806 - DNA, 573 bp, Homo sapiens
  misc_feature: GZ8MTXP02I2CWQ.17.28.C06.1.454.CMB.2.raw
  modified_base (404)..(404): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagcctggtccagcgtgggggtcctgagactctcctgtgcagcctccggacttccccttcagtagttattggatgacttgggtccgccagactccgagggaaggggctggagtggggtggaccgaacataaagcaagatggaactgcccgtagtttacgtggactctgtgaggggtccgtttcaccgtntctaccagacgacaacgccaaagaattacactagtactctacaactgaacagcctagagtagtcgcaagaccacggcgtgtattacgtgtgcgagataggtaggaaaacgtagtggacttggttagtttaaggttggggaccgtaggggacgccgtacggtcctacccg

SEQ ID NO: 411807 - DNA, 617 bp, Homo sapiens
  misc_feature: GZ8MTXP02GLHON.17.28.C06.1.454.CMB.2.raw
  modified_base (274)..(274): a, c, t, g, unknown or other
  modified_base (382)..(382): a, c, t, g, unknown or other
  modified_base (466)..(466): a, c, t, g, unknown or other
  modified_base (473)..(473): a, c, t, g, unknown or other
  modified_base (479)..(479): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgcttgttttagaaggtgtccagtgtgagtcagttggttgaggtccggggagcctggtccagccgtggggggtccctgagactctcctgtgcagcctccggattcccctnagtagttattggatgacgttgggtcccgccgagacctccgaggggaacgggctgggaggtggggtcggaccaaacataaaagcaaggatggaactgccgtagtttagnggactctggtagaacgggtccgtttacactaatcctccaagacgaacaaaccgacctaaaaggtatacacttgtaatcctaaanaacgtanaaaacncgactagagtacgcgacaggaccgtacggtcgtagtacttacgtggagagaagtaggtaaggtaaaggtaaaatagtggtacgttaggttagttagggtccggggacgacggggtacgcccgttacggccctacgtcc

SEQ ID NO: 411808 - DNA, 687 bp, Homo sapiens
  misc_feature: GZ8MTXP02GG6GK.17.28.C06.1.454.CMB.2.raw
  modified_base (211)..(211): a, c, t, g, unknown or other
  modified_base (244)..(244): a, c, t, g, unknown or other
  modified_base (248)..(248): a, c, t, g, unknown or other
  modified_base (279)..(279): a, c, t, g, unknown or other
  modified_base (300)..(300): a, c, t, g, unknown or other
  modified_base (323)..(323): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtccgtcgggacccccgggnaggagggtccaccatatcttgttctaggaaacncgcncgcatctactaactaattattgctcgtacanctactccgagcctccgccccnctcctctactactaataagaatntactctacgtccggcccgtccggtcctcgtaccctacttcgtcgtcgtctctgtcgtcgtcggacctaccgtccgaccgtccctccctaccgacctacgtacgtacggtccgggtcccgtcccgggtaccgtacggtacgtacggtacgtacgttagttaactttacgttacgtacggtcgtaccggtacggtagggtacgtacggtaacgtacgtacgtaagggtacggttcggggttaccggggttcgggtaccgggggaccggggtaacggggtaccggtacgggtacccgttaaccggtaccgttaaccgtaacggtacccgtaaccggaccccgtacggtccccgtacccggtcccccg

SEQ ID NO: 411809 - DNA, 606 bp, Homo sapiens
  misc_feature: GZ8MTXP02J29LK.17.28.C06.1.454.CMB.2.raw
  modified_base (244)..(244): a, c, t, g, unknown or other
  modified_base (297)..(297): a, c, t, g, unknown or other
  modified_base (371)..(371): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgctgttttagaaggtgtccagtgtgaggtccagttggttgagtcggggagctggtcagccgtgggggtcctganactctcctgtgcagcctcggacttccccttcagtattatggatgactggtccncagactccgagggaaggggctggagtggggtcggaccaacgataaagcaagatggaactgcccgtagtttacgnggtactgtcgtgacgggtccgtttacacctatcctaccagacgaacaaacgtaccaaagtaacttcaactgtactacgtaacaactcgaacagaccctgagcgcgacaagacaccgggtccgtagttactacttgacgcgagtagtaggtaaggtaaaaaagttagcgtacgttaggtttacgtttaaggttacgggggaccgacgggtaaccggtcccttcgggtacctcccgg

SEQ ID NO: 411810 - DNA, 631 bp, Homo sapiens
  misc_feature: GZ8MTXP02F0EJK.17.28.C06.1.454.CMB.2.raw
  modified_base (277)..(277): a, c, t, g, unknown or other
  modified_base (302)..(302): a, c, t, g, unknown or other
  modified_base (340)..(340): a, c, t, g, unknown or other
  modified_base (378)..(378): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggttgagtcgggggagctggtccagccgtgggggtccctgagactctcctgtgcagccctccggacttcccctnagtagttatggatgacttgggtccnccagactccgaggggagggctggaggtgggtgaccaanataaagcaaagataggaactggacccgtagttttacgnggtactcgtgtaggacggggtccttacacctactcctacagacaaccgaacgaccaaagtaaacttcaatagtacttactaacaactacgaacgacgtcctagacgagtccgacacgaccgtacgggtcccgttaggttaacttaacgtggttcgacgtaagagttaggtaaaggtaaaaagtagtaggtacgttggttaggtttaaggtacggggtaccgtaggggtaccgtccggtcggtaccttacccgg

SEQ ID NO: 411811 - DNA, 705 bp, Homo sapiens
  misc_feature: GZ8MTXP02IZPP5.17.28.C06.1.454.CMB.2.raw
  modified_base (208)..(208): a, c, t, g, unknown or other
  modified_base (267)..(267): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccggnaggagggtccaccatatcttgttctaggaaacagcctccggctatctacaaactaactnttttgctggtaccagcaacttccccgaggtactccccggccccccgactccctcatcgtaactagtaaatgaactcgacgtcccggccccgttcccggggtaccctcggaacccccgtactttccgtcgtcggtcctcccgtagtcggtcctcgggtaccctacccgtccgtaaccggtcccccttacccgtacgaacccctaacggttcccgaacggggttccgggtcccgtttacccgggtacccggaaggtaccgttgggaacgggtcttacggttaaatttacgtttaacccgttgttacgacccgggtaaaccgggtgggaattcggaactagtcccgtagtacgtcgggttccggtggtcggacgggtaggacctggtccgtacgtaccgaacgttaagccgacgtacccggacgtcccgtaccgtcccccg

SEQ ID NO: 411812 - DNA, 648 bp, Homo sapiens
  misc_feature: GZ8MTXP02HT78G.17.28.C06.1.454.CMB.2.raw
  modified_base (186)..(186): a, c, t, g, unknown or other
  modified_base (206)..(206): a, c, t, g, unknown or other
  modified_base (234)..(234): a, c, t, g, unknown or other
  modified_base (242)..(242): a, c, t, g, unknown or other
  modified_base (258)..(258): a, c, t, g, unknown or other
  modified_base (408)..(408): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccacctnagtgtcgtcgggaccccggnaggaggtcaccatatcttgtctagaacngctccggnatctacaaactaactnttttgctgtaccagactaacttccgaggactccccggcccccgtactcctacactactaataagaaatgactcgacgtcccggcccgttccccggggtcctacgaccccgtattccgtcgtcgccttccagtcgtcgtcgacctaccgtnaccgtccctccgacacctcgtcgcggtcggtcccgttccgggtaccgaggtacgcgtacggcttagttatttaagttacgttgacggtaccgaccggttgggaattcgaacctgtccgtaggtaacggttcgggttccggtaacgggttcgggaccgggacgggtccgacggttccgaccggtaccgttaaccgtaacggccgtaaccgaccgtaaccggcccggtaccctccccccggg

SEQ ID NO: 411813 - DNA, 639 bp, Homo sapiens
  misc_feature: GZ8MTXP02FH4FW.17.28.C06.1.454.CMB.2.raw
  modified_base (282)..(282): a, c, t, g, unknown or other
  modified_base (398)..(398): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgcttgttttagaaggtgtccagtgtgaggtccagttggttgaggtccgggggagctggtccagccgtgggggtccctgagactctcctgtgcagcctccggtacttccccttnagtagttatggatgacttgggtccgccagacctccgaggggaaggggctgggaggtggggtggacccaaacaagtaaaagcaaagataggaaactggaccccgttagtttttacgnggtactcgtggtggacgggtcccgttcactctctacagagaacaacgacccaaagtaacttcaactgtacttactaacaactacgaacacgtcctagagacgtcgacgaagaccgacggtccgttagtacttacgtgtcggacgagagttaggtaaaggaaaaagttacgtggtactggtttaggtttaaggttcgggggacccgtaagggggtccgtcccgtacgggtacccgtaacccg

SEQ ID NO: 411814 - DNA, 568 bp, Homo sapiens
  misc_feature: GZ8MTXP02IWQJX.17.28.C06.1.454.CMB.2.raw
  modified_base (261)..(261): a, c, t, g, unknown or other
  modified_base (467)..(467): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggcagagggtcaccatatcttgttctaggaaacagctccggcatctacaactaaactnttttgctggtaccagcaattccccaggactcccggccccccgactcctcactctatagaaatgatcatccggccctccggggtcctcgaccccgtattctctggctccatgtctggacctacctcacgccctccctgaccatcgaggtcgggcctccggtccgaggtatcgagctagatttatacgtgtgcgaccggtggatgacncgtcctagaagtcgggtccggtggttacgggcgggtacggaccgacggtcgtcgacccgtcgtaaacgtccgacgacccgacggtccttacccggcccccg

SEQ ID NO: 411815 - DNA, 641 bp, Homo sapiens
  misc_feature: GZ8MTXP02HM58O.17.28.C06.1.454.CMB.2.raw
  modified_base (304)..(304): a, c, t, g, unknown or other
  modified_base (397)..(397): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggagctggtccagccgtgggggtccctgagactctcctgtgcagcctccggactttccccttcagtagttattggatgacttgggtccnccgagacctccgaaggggaaggggctggggaggtggggtcggaccaacgaataaaaggcaaagagtggaaactggaccccgtagtttttacgnggtacttcgtggtaggacggggtccctttacgaccctattcctacccgaagacgaacctaaacgacccaaagtaacttacaacttgtaactacttaaacaactacgaaacagtccctagacgtagtacgacaacgacgaccggccgtagttattacgtgtgcgaagagttaggaaagtaaaaagtaatgggtacttggttagtttaaggttcggggcgagggacgtcccgtggtaccgtacccg

SEQ ID NO: 411816 - DNA, 609 bp, Homo sapiens
  misc_feature: GZ8MTXP02HTYV0.17.28.C06.1.454.CMB.2.raw
  modified_base (445)..(445): a, c, t, g, unknown or other
  modified_base (455)..(455): a, c, t, g, unknown or other
  modified_base (461)..(461): a, c, t, g, unknown or other
  modified_base (465)..(465): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggttgagtcggggagctggtcagccgtgggggtcctgagactctcctgtgcagccctccggtacttccccttcagttagttagttggatgtacgttcgggtccgccgagacctccgaggggaaggggcgtgggagtggggtggccaaacataaagcaaagatggaactgacccgtagtttacgtgactctgtgacgggtcgttcacatcacagacacaacgccaagaactcatgtatactanaactagaacngtaccngagngtcgagacgacgacggcgtgtaactcgtgacgtacggagtagttaggaaaaggtaaaacgttaggtcggtacgttggttaaggttttaacgggttcggggaaccggtagggggtacccgtaccggtcggttaacccgtccccgg

SEQ ID NO: 411817 - DNA, 679 bp, Homo sapiens
  misc_feature: GZ8MTXP02FRA6N.17.28.C06.1.454.CMB.2.raw
  modified_base (229)..(229): a, c, t, g, unknown or other
  modified_base (278)..(278): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgcttgttttagaaggtgtccagtgtgaggtccagttggttgaggtcggggagctggtccngccgtgggggtccctgagactctctgtgcagccctccggacttcccctnagtagttatggatgacgttcggtccgcagacgtccgaaggggaaggggctagggaggtggggtacgaccgtaaacaagtaaaagacgaaagagtaggaaactggaccccgttaagttttacgagtacttgtggttacggtacggggtcccgtttacacctactctacgagtacaaccgaacgacctaaagtaacttacactagtacttactaaactaactacgaaactacgacccgttaaggaacgtacggtaccgaacgaaacggtaacccgaacggtcccgttaagtttaactccgtaggtcgaagtagtagttaggaaaggtaaaaagtagtaggtacgtggtttaggttaacggtacggggaccgtagggtaccggtccgtagggtccctaacccgg

SEQ ID NO: 411818 - DNA, 664 bp, Homo sapiens
  misc_feature: GZ8MTXP02GRELH.17.28.C06.1.454.CMB.2.raw
  modified_base (368)..(368): a, c, t, g, unknown or other
  modified_base (652)..(652): a, c, t, g, unknown or other
  modified_base (654)..(654): a, c, t, g, unknown or other
  modified_base (656)..(656): a, c, t, g, unknown or other
  modified_base (658)..(658): a, c, t, g, unknown or other
  modified_base (660)..(660): a, c, t, g, unknown or other
  modified_base (662)..(662): a, c, t, g, unknown or other
  modified_base (664)..(664): a, c, t, g, unknown or other
tcagcgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaactatttttgctggtaccagcaattcccaggactccggccccccatcctcatctatagaaatgatcatccggcccgtccgggtccctgaccgtattctctggcctccatgtctcggaccacctcacgtcctccctgaccatcgaggtcgggcctccgggtaccgaggagtcggaggcttagtattagttacngtgaccgtcggtagggactgactcgtccgtaggacgttcggggttccggtgggttccggggacggggtaggggaccctaacggtcgtacggtacccggtaccgtaaagtcccgaacggaccccgaaagggtccctccggtacccccgtcggtaaccctccgttccgtcccgttcccccgtacccttaccccgtccgtaacggttcctaccgggtaccgtcgggtacgggcccgggcgttaccgggggacgaacccggggcgtaaccgaacgtacgacgcgcgcncncncncncncn

SEQ ID NO: 411819 - DNA, 626 bp, Homo sapiens
  misc_feature: GZ8MTXP02JY3KG.17.28.C06.1.454.CMB.2.raw
  modified_base (374)..(374): a, c, t, g, unknown or other
  modified_base (379)..(379): a, c, t, g, unknown or other
  modified_base (386)..(386): a, c, t, g, unknown or other
  modified_base (399)..(399): a, c, t, g, unknown or other
  modified_base (452)..(452): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggttgagtccggggagcctggtccagccgtgggggtccctgagactctcctgtgcagcctccggattccccttcagtagttattggatgacttgggtccgccagactccgaggggaggggctggagtgggtgccaacataaagcaagatggaactgccccgtagtttacgngactntgtgagngccgtttcacctntctccagacgacaacgccaaagaacttcactgtatactaacaactagaaaccngtacctaggaggtacgtcggacaggaccgacggtacccggtagttacttacgtggtcgacggtaaggtagtagggtaaagggtaaaaagtaacgtgggtactttaggttaacggtttttaagggtacgggggtacccgaaagggggtcccgtccccggttacggggtttacccg

SEQ ID NO: 411820 - DNA, 572 bp, Homo sapiens
  misc_feature: GZ8MTXP02GGACK.17.28.C06.1.454.CMB.2.raw
  modified_base (368)..(368): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggtgagtcggggagcctggtcagcctgggggtccctgagactctcctgtgcagcctccggattccccttcagtagttattggatgacttgggtccgcagactccgagggaggggctggagtgggtggccaacataaagcaagatggaactgcccgtagtttacgnggactcgtgtgaggggtcctttcacctatcctccagacgacaacgccaagaattcaactgtactctaacaactagaacagcctgacgagtcgcagacacggccgtgtacttacgtgtgacggagattaggtaacggaaaaagtagtacggcttggttagtttaaggtcgggggtaccaggggacgtcccgtggtacgtacccgg

SEQ ID NO: 411821 - DNA, 610 bp, Homo sapiens
  misc_feature: GZ8MTXP02JVCL7.17.28.C06.1.454.CMB.2.raw
  modified_base (342)..(342): a, c, t, g, unknown or other
  modified_base (376)..(376): a, c, t, g, unknown or other
  modified_base (459)..(459): a, c, t, g, unknown or other
  modified_base (498)..(498): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattccccttcagtagttattggatgacttgggtccgccagactccgagggaaggggctggagtggggtggccaanataaagcaagatggaaactgcccgtagtttacgngactctgtgagggtcccgtttcaccagtctccgagacgacaaaccgccaaagaattcactgtatactaacaactacgaacacncctagacgagtcgacaagaccacggccgtagtacttacngtgacgtagagtaggtaaggtaaaaagtagtacgggtacgttaggttaggtttaacgtttcggggggaccgtaagggggacgtaccccggttcggggtacccttaaccccgg

SEQ ID NO: 411822 - DNA, 657 bp, Homo sapiens
  misc_feature: GZ8MTXP02HPSWJ.17.28.C06.1.454.CMB.2.raw
  modified_base (303)..(303): a, c, t, g, unknown or other
  modified_base (390)..(390): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgctgttttagaaggtgtcagtgtgaggtcagttggtgaggtcggggagctggtcagccgtgggggtcctgagactctctgtgcacgcctccggtacttccccttcagtagttattggatgtacgttgggtccnccagacctccgaggggaaggggctggaggtgggtcggaccaaacgaataaaagcaaagagtaggaactgaccccgtagtttttacgnggacttcgtggtaggacggggtccgtttacacctagtcctaccgagacgaacaaccgaccaaagtaactcacttagtatactaaacaactacgaaacacgtaccgtagaagtacgcggacgaagaccgaccggtaccgttagttaacttacgtggtacggacgaaggtaagttagggtaaaaggtaaaaaagtacgttcggacgtttaggtttaggtttaaggttcgggggaccgaggggaccgtcccgtacggttacctaccccgg

SEQ ID NO: 411823 - DNA, 634 bp, Homo sapiens
  misc_feature: GZ8MTXP02JITG7.17.28.C06.1.454.CMB.2.raw
  modified_base (401)..(401): a, c, t, g, unknown or other
  modified_base (482)..(482): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggagctggtccagccgtgggggtcctgagactctcctgtgcacgcctccggactttccccttcagttagttatttggatgacgttgggtccgccagacctccggaggggaggggcgtgggaggtggggtggaccaaacgaataaaagcaaagatagggaaactcggccccgtagttttacggnggtactcgtggtggacggggtcctttacacctatcctcgagacgacaacgaccaagaattcactagtactactacaactanaacacgcctagacgtagtcgacgacgaccgacggtccgtaggtacttacgtgtacgcgagtagtacggtaaaaggtaaaagtaagtcggtacgttgttaggtttaacggtcggggtaccgaagggggtccgtcccggttgtccgttaacccg

SEQ ID NO: 411824 - DNA, 630 bp, Homo sapiens
  misc_feature: GZ8MTXP02GV5TW.17.28.C06.1.454.CMB.2.raw
  modified_base (389)..(389): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagccgtgggggtccctgagctctcctgtgcagcctccggattcccctcagtagttattggatgacttgggtccgcagacctccgaggggaggggtctggaggtggggtcggaccaaacgaataaagcaaagagtaggaactggaccccgtagttttacgnggtactcgtgtagacggggtccttcgacctatcctaccagacgaacaacgccaaagacttcactgtactactaacaactagaacagtcctagaggtacgtccgacaagaccgacggccgttagttaacttacgtggtacgacgtaaagtagttaggtaaagggtaaaaagttagtacggtcgttagttaggtttaaggtcgggggacgtaaggggccgtccggttacggtacccgtacccg

SEQ ID NO: 411825 - DNA, 656 bp, Homo sapiens
  misc_feature: GZ8MTXP02JC095.17.28.C06.1.454.CMB.2.raw
  modified_base (216)..(216): a, c, t, g, unknown or other
  modified_base (273)..(273): a, c, t, g, unknown or other
  modified_base (392)..(392): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggtgagtcggggngctggtcagccgtgggggtcctgagactctcctgtgcacgcctccggacttcccctnacgttagttattggatggacgttcgggtcccgccgagaccgtccgaaggggaaggggcgtgggaggtggggtcggaccaacgaataaagcaaagataggactggacccgtagtttacgngtactcgtgtgacggggtcctttacacctatcctacgagacgaaccacgaccaaagtatcaatgtactactaacaactacgaacacgacccgaggacgtcgacgtacgaccgaccgggtccgttagtacttacgtcggtacgtacggaagtagtacggtaaaagggtaaaaacggttagttagggtaccgttaggttttacggttaaagttcgggggaccgtaaacgggggcgtcccgttacgggtacccgtacggtttccccg

SEQ ID NO: 411826 - DNA, 636 bp, Homo sapiens
  misc_feature: GZ8MTXP02GOBHZ.17.28.C06.1.454.CMB.2.raw
  modified_base (306)..(306): a, c, t, g, unknown or other
  modified_base (343)..(343): a, c, t, g, unknown or other
  modified_base (381)..(381): a, c, t, g, unknown or other
  modified_base (499)..(499): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagccgtgggggtccctgagactctctgtgcacgcctccggattcccccttcagtagttattggatgacttgggtccnccagactccgaggggaggggctggagtgggtgccaanataaagcaaagatggaaactgaccccgtagttttacgnggtactcgtgtagacggggtccgtttacaccgtatcctaccgaagacgaaccaacgacccaaaagtaacttcacttagtaactactaaacaacgtagaaacacgcctagagagtcganaacgaccgacggaccgttagtattacgtgtaggacgtaaggagttaggtaaacgggtaaaaatagtgggtacttaggtttaggtttaaggttcgggggacctaagggggaccgtacccggtacggtccgtaaccccg

SEQ ID NO: 411827 - DNA, 590 bp, Homo sapiens
  misc_feature: GZ8MTXP02FRI7Z.17.28.C06.1.454.CMB.2.raw
  modified_base (374)..(374): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgtttagaggtgtccagtgtgaggtcagttggttgagtcggggagcctggtccagccgtgggggtccctgagactctcctgtgcagcctccggattccccttcagtagttattggatgacttgggtccgccagactccgagggaaggggctggagtgggtgccaacataaagcaaagatggaaactgccccgtagttttacgnggtactctgtgaggggtcctttcacctatcctccagacgaacaacgaccaaagaacttcgacttgactctaacaactagaacagcctgagagtcgacgagaccgacgggcctgttaacttcgtagtgacgagataggtaaggaaaaagtacgtaggtacttggtttagtttaagttcgggggacgtacggggacgtcccggtagggtcctacccgg

SEQ ID NO: 411828 - DNA, 560 bp, Homo sapiens
  misc_feature: GZ8MTXP02I222B.17.28.C06.1.454.CMB.2.raw
  modified_base (377)..(377): a, c, t, g, unknown or other
  modified_base (383)..(383): a, c, t, g, unknown or other
  modified_base (432)..(432): a, c, t, g, unknown or other
  modified_base (460)..(460): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggttgagtccgggggagcctggtccagcctgggggtccctgagactctcctgtgcagccctccggattcccctcagtagttattggatgacttggtcccgccagactccgagggaaggggctggagtggggtggccaacataaagcaagatggaactgaccccgagttttacgnggactntgtgagggtccttcacatctcagcgacaacgccaagattcactgtactntacaactagaacagcctggagtagtcgnacgacacggccgtgtattactgtgcgagagtaggtaaggaaaaaggtataggcgttgtagtttaagtcggggacctagggggactccgtggtactacccg

SEQ ID NO: 411829 - DNA, 614 bp, Homo sapiens
  misc_feature: GZ8MTXP02HBBNF.17.28.C06.1.454.CMB.2.raw
  modified_base (346)..(346): a, c, t, g, unknown or other
  modified_base (384)..(384): a, c, t, g, unknown or other
  modified_base (457)..(457): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtcagttggtgagtcggggagctggtcagccgtgggggtccctgagactctcctgtgcagcctccggacttccccttcagttagttattggatgacgtttcgggtcccgccagacctccgaaggggaaggggctgggaggtggggtggccaaanagtaaaagcaagagtagaactggaccgtagttttacgnggactgtgtagaagggtcctttacaccatcctaccgagacgacaacgccaaagatcactgtatcaacaactanaacagaccgtgagacgtcgacgagacgacggccgtagtattactggtcgacgagtacgtaggtaaaggaaaaagtagtaggtacgttaggttagtttaacggttcgggggaccgtaacggggtacgtcccgttcgggtacccgtaccggtttccccg

SEQ ID NO: 411830 - DNA, 566 bp, Homo sapiens
  misc_feature: GZ8MTXP02JTAHG.17.28.C06.1.454.CMB.2.raw
  modified_base (486)..(486): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagctggtccagccgtgggggtcctgggactctcctgtgcagcctccggacttcccctcagtagttattggatgacttgggtccgccagactccgaggggaaggggctgggaggtggggtggccaacataaaagcaagatggaactgccgtagtttacgtgactctgtgaacgggccgtttcacctatctccagagacaacgccaaagactcactgtatctaacaactgaacacgcctagagagtcgacagacgacgccgtagtattacngtgcgagagtaggaggaaaaagtatggctgttgtttagtgggggaccagggggacgcccgttggacccgtaccgttcccg

SEQ ID NO: 411831 - DNA, 592 bp, Homo sapiens
  misc_feature: GZ8MTXP02I6THD.17.28.C06.1.454.CMB.2.raw
  modified_base (237)..(237): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggcagagggtcaccatatcttgttctaggaaacngctccggcatctacaactaaactattttgctggtaccagcaacttcccgaggactccggccccccgactcctcatctaatagaaatgatcatcggccctccggggtccctgaccccgtattctctcggctccatcgtctggccacctcacgccctccctgacccatcagtcggcctccggtccgaggactgacggtctagattagttactgtacgccgtaccggtgggataggacacttccgtagaacgtcggggttacccggtggttccggggacgggacgggaccgacggtccgtacggaacccgttcgtaaacgtccgaaccggcccgaaacgggtccctacggtccccccg

SEQ ID NO: 411832 - DNA, 676 bp, Homo sapiens
  misc_feature: GZ8MTXP02JTN17.17.28.C06.1.454.CMB.2.raw
  modified_base (278)..(278): a, c, t, g, unknown or other
  modified_base (395)..(395): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggagcctggtccagccgtgggggtccctgacgactctcctgtgcagcctcggattcccctnagttattattggatgacgttggtcccgcagacctccgagggaggggtctaggaggtgggtggacccaagaagttaaaagcaaagagtggaaacttggaccccgtaggtttttaccgnggtaacttcgtggtgacgggggtcctttcaccagttccaccagacgacacgaccaagaatcactgtactacgtaacaactagacaacgcctaggagagtacgcgaaccgacgacccgggtacccgtagttaacttaccgtgtcgaccgaacggtagttacgggtaaaacggtaaaaaaggttaccgtaagggtaacccgttgggtttaacgtttaaggggtttccgggggtaaactaacgggggaaacccgtcccgtttacggggtacccttaacccccgg

SEQ ID NO: 411833 - DNA, 667 bp, Homo sapiens
  misc_feature: GZ8MTXP02FR4VA.17.28.C06.1.454.CMB.2.raw
  modified_base (207)..(207): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggnaggaggtccaccatatcttgttctaggaaacacgctccggcatctacaactaactattttgctagtaccagctaacttcccgaggactccggccccccgtactcctcattactataagaaatgatcactcccggtccccgtccggggtccctcggaccccgtacttctcgtcgtctcctatcgtcgtcggcctaccctccacgtcccctcctcgacctactcgacgggttcggcccgttcccgggtaccggtaggaagtcgggaacggtcttacggttaatttacgtttaaccgtggttacgaccggttaccgggtaggggtactacggtacctagtcccgtaagggtacgttcggggtccggttcgggtacgggaccgggtaacgggtaccgtcggaccgtaccgtacccgtaacgtaaccggtacgaccggtacccgtacgggccctcccggtccccg

SEQ ID NO: 411834 - DNA, 622 bp, Homo sapiens
  misc_feature: GZ8MTXP02HGWHH.17.28.C06.1.454.CMB.2.raw
  modified_base (234)..(234): a, c, t, g, unknown or other
  modified_base (382)..(382): a, c, t, g, unknown or other
  modified_base (602)..(602): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgcttgttttagaaggtgtccagtgtgaggtcagttggttgaggtcggggagctggtcagttccgngggggtccctgagactctcctgtgcagccctccggattcccccttcagtagttattggatgacttggtccgccagactcgaggggaggggctggagtggggtggccaacagtaaagcaaagatggaactggaccccgtagttttacgnggacttctgtgacggggtccgtttcaccctatcctaccgaagacgaaacctaaacgacccaaagtaactttcaaccgttgtaactaccttaacaaactagaaacaaggcccttaggagtacgtaccgcacgacgaccggtccgtagtattacgtgtgcgtagagtaggtaaaggaaaaagttacaggtctgtttaggtttaagtaggggctaggggtacncccggttaggtcctacccgg

SEQ ID NO: 411835 - DNA, 602 bp, Homo sapiens
  misc_feature: GZ8MTXP02HDXFK.17.28.C06.1.454.CMB.2.raw
  modified_base (273)..(273): a, c, t, g, unknown or other
  modified_base (299)..(299): a, c, t, g, unknown or other
  modified_base (334)..(334): a, c, t, g, unknown or other
  modified_base (369)..(369): a, c, t, g, unknown or other
  modified_base (379)..(379): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgttttagaaggtgtccagtgtgaggtcagttggtgagtcggggagctggtccagccgtgggggtcctgagactctctgtgcagcctccggattcccctnagtagttattggatgacttgggtccncagactccgaggggagggctggagtggtcggcaanataaagcaaagatggaactgccccgtagtttacgnggtactctgnggacgggtccgtttcacctatctaccagacgaacaacgaccaaagaactttcaacttgtactactaacaactacgaacaaagtccagagtagacgcgagacgacggtccgtagtacttactgtgacggagagtaggtaaagggaaaaagtaagtacggttacgtggtttaggtttaacgtttacgggggacgtacgggacggtacccgtcgggtacctcccgg

SEQ ID NO: 411836 - DNA, 685 bp, Homo sapiens
  misc_feature: GZ8MTXP02GEQXS.17.28.C06.1.454.CMB.2.raw
  modified_base (243)..(243): a, c, t, g, unknown or other
  modified_base (252)..(252): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcacgccaccctcagtgtcgtcggggacccccgggcaggagggtcaccatattcttgttctaggaaacngcctccggnactctacaaactaaactattttgcgtagtaccagactaacttccgaggacctcccggacccccctatcctctatacctaataagaaatgactcacgtccggtccccgtccggggtccctaggtaccgtaccttcgtcgtcggtacctccagttcgtcgtcgccctacctaccgacgtcccctccgtacgaccctatcgacggtcggcctccggggtaccgaggtacgacggcggtactaggtttaaatttacgttacgttggtacgacccgggtaacggttagggaaacttcgaacttccgtaccgttaggtaacggttcggggttaaccggttcgggttacggggacgggtacggacccggtggtaccgtaccggtaccgttaaccgaagtacccggacgtaccccgacggtaccgttcccgtccccgtccg

SEQ ID NO: 411837 - DNA, 586 bp, Homo sapiens
  misc_feature: GZ8MTXP02HWBK0.17.28.C06.1.454.CMB.2.raw
  modified_base (273)..(273): a, c, t, g, unknown or other
  modified_base (378)..(378): a, c, t, g, unknown or other
  modified_base (404)..(404): a, c, t, g, unknown or other
  modified_base (487)..(487): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggtgagtcggggagcctggtcagcctgggggtcctgagactctcctgtgcagcctccggtattccccttnagtagttattggatgtacttggtccgccagactccgagggaaggggctggagtgggtgccaacataaagcaaagataggaactcgcccgtagtttacgtggactntgtgagggtctttcactatctcaganacaacgaccaaagatcactgtactactacaactgaaacagcctagagtacgtcgacaacgacgacggtccgtagtacttacgngtgacgaagataggtaaggaaaaagttagtaggacgttaggttaggtttaaggttcgggggacgtaacgggggtacctcccgttggtaccctaccccgg

SEQ ID NO: 411838 - DNA, 606 bp, Homo sapiens
  misc_feature: GZ8MTXP02GK824.17.28.C06.1.454.CMB.2.raw
  modified_base (239)..(239): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccggcaggagggtcaccatatcttgttctggaaacngctccggcatctacaaactaaactattttgctggtaccagctaacttcccaggactccggccccccactcctcactcgtaatagaaaatgactcacgtccggccccgtccggggtccctcgaccccgtacttcctcgtggcctccatcgtctcggcctaccctcacgccccttccctcgaccctatcaggtcgggccgtcccggtccgaggagtgaggctaggtattagttacgtgtcgccgtacggtgggatcgactactcctagtaacgttcggtccggttggtcgggcgggacggtaccgacggcctacggacccgtaaccgtaacggtccaacggacccgaacggcccgtacccggtcccccg

SEQ ID NO: 411839 - DNA, 636 bp, Homo sapiens
  misc_feature: GZ8MTXP02GTYCF.17.28.C06.1.454.CMB.2.raw
  modified_base (375)..(375): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtccagtgtgaggtcagttggtgagtccggggagctggtccagccgtgggggtcctgagactctcctgtgcagcctccggacttccccttcagtagttagttggatgacttgggtccgccagacctccgagggaggggctggaggtgggtggccaacgataaagcaagatggaactgccccgtagtttacgngactcgtgtagagggtccttacacctatcctacagacgacaacgaccaaagtaacttcactgtactctaacaactagaacacgcctagacgagtcgacgaacgaccgacgggccgttataacgtttactggtagaggtaaagtaggtaaggtaaacggggtaaaaaagttacgtcggggtactttagggtttaggttttaacggttcggggggaccgtaacgggggtaccgcccggtttacggggtacccttaacccccgg

SEQ ID NO: 411840 - DNA, 665 bp, Homo sapiens
  misc_feature: GZ8MTXP02GP6YK.17.28.C06.1.454.CMB.2.raw
  modified_base (266)..(266): a, c, t, g, unknown or other
  modified_base (290)..(290): a, c, t, g, unknown or other
  modified_base (367)..(367): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtcagtgtgagtcagttgtgagtcggggagctggtccagccgtgggggtcctgagactctcctgtgcagcctcggacttccccttnagtagttatggatgacttggtccnccagactccgagggagggctggagtgggtggccaaacagtaaaacgcaaagataggaactggaccgtagttttacgnggtacttcgtggtaggaacgggtcccgtttacaccgtattcctcccgaagacgaaaccaaaccgaccaaaagtaacttccacttagttactacctaactaaacgttacgaaaccacggtacccgttaggaacgtacggtacgacgaacggaaccgaccggtacccgtagttacttacgtggtgacgaagtagtagggtaaaggtaaaaacgttaggtaggtacttaggttaggttttaagtcgggggtaccgtaacgggggacccgtacccgtagggttaccctaacccggtttcccg

SEQ ID NO: 411841 - DNA, 592 bp, Homo sapiens
  misc_feature: GZ8MTXP02FW8O9.17.28.C06.1.454.CMB.2.raw
  modified_base (279)..(279): a, c, t, g, unknown or other
  modified_base (305)..(305): a, c, t, g, unknown or other
  modified_base (383)..(383): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagccgtgggggtccctgagactctcctgtgcagcctccggattccccttnagtagttattggatgacttgggtccnccagactccgagggaaggggctggagtggggtgaccaacagtaaagcaaagatggaaactggccccgtagttttacgngactctgtgagggccttcacatctcagagacacgaccaagaattcactgtatcttaacaactagaacagccgtagagacgtacgacgagaccgacgggccgtagttaacttacgtgtgcgtaagagtaggtaaggaaaaaggttacgtagggacttggttaggtttaagtcgggggtaccagggggacgtcccgtaggtctaaccccgg

SEQ ID NO: 411842 - DNA, 622 bp, Homo sapiens
  misc_feature: GZ8MTXP02H3ABP.17.28.C06.1.454.CMB.2.raw
  modified_base (385)..(385): a, c, t, g, unknown or other
  modified_base (511)..(511): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggttttccttgttgctgttttagaagtgtccagtgtgaggtccagttggtgaggtcggggagcctggtccagccgtgggggtccctgagactctcctgtgcagcctccggatttcccctcagtagttattggatgtacttgggtccgccagactccagtgggaaggggctgggagtgggtggaccaaacaataaaagcaaagataggaaactcgaccgtagtttttacgnggtactcgtgtggaacgggtcctttacacctatcctccaggacgaccaaacgtacccaaagaacttacgacttagtactactaacactagaaacagaccgtgagagtcgacagaccgacggccgtnttaagttacgtgtaggacgagtagtacgtaaaggaaaaagttacgtaggtcgtttaggttaagtttaggttacgggggaccgtaggggaccgtcccggttacggttacccg

SEQ ID NO: 411843 - DNA, 577 bp, Homo sapiens
  misc_feature: GZ8MTXP02F3DDV.17.28.C06.1.454.CMB.2.raw
  modified_base (270)..(270): a, c, t, g, unknown or other
  modified_base (294)..(294): a, c, t, g, unknown or other
  modified_base (374)..(374): a, c, t, g, unknown or other
  modified_base (399)..(399): a, c, t, g, unknown or other
  modified_base (409)..(409): a, c, t, g, unknown or other
  modified_base (485)..(485): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgtttagaggtgtccagtgtgagtcagttggttgaggtcggggagctggtccagccgtgggggtccctgagctctcctgtgcagcctcggattcccctnagtattatggatgacttgggtccncagactccgaggggaggggctgggagtgggtcgaccaaacagtaaagcaaagataggaactggaccccgtagttttacgnggactgtgtgaggggtccttcactntcctacaganacaacaccaagatcacttgtatactacaactagaacagcctaggagagtcacagacgacggtcgtagttattacgngtcggacgtagagttggaaagggtaaaaagtacgtggtacttggtttagtttaaggtcggggtacgaggggtacgtccgtggtacctacccg

SEQ ID NO: 411844 - DNA, 591 bp, Homo sapiens
  misc_feature: GZ8MTXP02JTX69.17.28.C06.1.454.CMB.2.raw
  modified_base (243)..(243): a, c, t, g, unknown or other
  modified_base (391)..(391): a, c, t, g, unknown or other
  modified_base (400)..(400): a, c, t, g, unknown or other
  modified_base (482)..(482): a, c, t, g, unknown or other
  modified_base (575)..(575): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagcctggtccagccgtgggggtcccngagactctcctgtgcacgcctccggacttccccttcagttagttattggatgtacttgggtccgcagacctccgaggggaggggctggaggtggggtcggaccaaagagtaaaaggcaaagatggaaactggaccccgtagtttacgngactcgtgngagggtccgttcaccatctcagacgacaacgaccaaagaactcactagtactactaacaactgaacagcctagagagtcganaagaccgacggtcctagtacttactgtcgagagtagtaggtaaaggaaaaagtagtcggacttagtagtttaaggcgggtaccgagggtaccncccgttaggcctaccg
